US011117938B2

(12) United States Patent
Chiu et al.

(10) Patent No.: US 11,117,938 B2
(45) Date of Patent: Sep. 14, 2021

(54) RNA INTERFERENCE FOR CONTROL OF INSECT PESTS

(71) Applicant: Regents of the University of California, Oakland, CA (US)

(72) Inventors: Joanna C. Chiu, Concord, CA (US); Katherine A. Murphy, Davis, CA (US)

(73) Assignee: The Regents of the University of California, Oakland, CA (US)

( * ) Notice: Subject to any disclaimer, the term of this patent is extended or adjusted under 35 U.S.C. 154(b) by 282 days.

(21) Appl. No.: 16/061,321

(22) PCT Filed: Dec. 13, 2016

(86) PCT No.: PCT/US2016/066346
§ 371 (c)(1),
(2) Date: Jun. 11, 2018

(87) PCT Pub. No.: WO2017/106171
PCT Pub. Date: Jun. 22, 2017

(65) Prior Publication Data
US 2019/0037854 A1     Feb. 7, 2019

Related U.S. Application Data (60) Provisional application No. 62/266,862, filed on Dec. 14, 2015.

(51) Int. Cl.
| | |
|---|---|
| *A61K 48/00* | (2006.01) |
| *C07H 21/04* | (2006.01) |
| *C07K 14/435* | (2006.01) |
| *C12N 9/18* | (2006.01) |
| *A01N 63/60* | (2020.01) |
| *C12N 15/113* | (2010.01) |

(52) U.S. Cl.
CPC ........ *C07K 14/43581* (2013.01); *A01N 63/60* (2020.01); *C12N 9/18* (2013.01); *C12N 15/113* (2013.01); *C12N 2310/14* (2013.01)

(58) Field of Classification Search
CPC .......................... C12N 15/113; C12N 2310/14
See application file for complete search history.

(56) References Cited

U.S. PATENT DOCUMENTS

| | | | | |
|---|---|---|---|---|
| 8,318,474 B1 * | 11/2012 | Smolke | ............... | C07K 14/395 435/255.1 |
| 2003/0108520 A1 | 6/2003 | Borovsky et al. | | |
| 2009/0285784 A1 * | 11/2009 | Raemaekers | ...... | C12N 15/8286 424/93.2 |
| 2012/0240288 A1 * | 9/2012 | Ye | ...................... | C12N 15/8286 800/279 |
| 2014/0026255 A1 * | 1/2014 | Grunden | ............ | C12N 15/8271 800/278 |

FOREIGN PATENT DOCUMENTS

| | | | | |
|---|---|---|---|---|
| WO | WO 03/099298 A1 * | 12/2003 | ........... | C12N 15/113 |
| WO | WO 2013/156492 A2 * | 10/2013 | ........... | C12N 15/113 |
| WO | WO 2014/106838 A2 * | 7/2014 | ........... | C12N 15/113 |
| WO | 2015/153339 A2 | 10/2015 | | |

OTHER PUBLICATIONS

International Search Report and Written Opinion dated Mar. 27, 2017 in International Application No. PCT/US2016/066346, 10 pages.

Baum, J.A., et al.; "Control of coleopteran insect pests through RNA interference"; *Nature Biotechnology*; vol. 25, No. 11; Nov. 2007; pp. 1322-1326.

Zhang, J. et al.; "Full crop protection from an insect pest by expression of long double-stranded RNAs in plastids" *Science*; vol. 347, Issue 6225; Feb. 27, 2015; pp. 991-994.

\* cited by examiner

*Primary Examiner* — Amy H Bowman
(74) *Attorney, Agent, or Firm* — Kilpatrick Townsend and Stockton LLP (57) ABSTRACT

This invention provides a methods and compositions for controlling an insect pest. The methods comprise contacting the insect pest with a composition comprising a yeast cell comprising a nucleic acid encoding a dsRNA molecule which specifically inhibits expression of a target gene in the insect pest, thereby controlling the insect pest.

22 Claims, 6 Drawing Sheets
Specification includes a Sequence Listing.

RNA INTERFERENCE FOR CONTROL OF INSECT PESTS

CROSS-REFERENCES TO RELATED APPLICATIONS

This application claims priority under 35 U.S.C. § 119(e) to U.S. Application No. 62/266,862, filed Dec. 14, 2015, which is incorporated herein by reference.

FIELD OF THE INVENTION

This invention relates to methods and compositions for controlling insect pests using RNA interference.

BACKGROUND OF THE INVENTION

In recent years, RNA interference (RNAi) has shown great potential to become a powerful tool in pest management. RNAi is effective in many economically important insects, including honey bee, mosquito, Western corn rootworm, and Colorado potato beetle [1-5]. Inducing mortality through RNAi has several advantages over conventional chemical pesticides. As a consequence of its sequence dependent mode of action, RNAi can be tailored to target only pest species and spare beneficial insects[6,7]. This is accomplished by choosing to target unique mRNA sequences within the pest species. Likewise, RNAi pesticides can be designed to target a broad range of insects by choosing sequences that are more conserved between species. Another advantage of RNAi pesticides is that the "active ingredient" is RNA, which is organic, biodegradable, and can be cheaply produced within microorganisms.

RNAi is a cellular mechanism that likely evolved to protect eukaryotes from RNA viruses[8]. To activate the RNAi pathway, double stranded RNA (dsRNA) can be fed to insects and absorbed into the cells that line the midgut. Exogenous dsRNA is usually processed into 20-30 nucleotide duplexes by the ribonuclease III enzyme DICER[9]. These nucleotide duplexes are incorporated into the RNA induced silencing complex (RISC) by the catalytic component ARGONAUTE. The two strands of RNA are unwound and one strand is used as a guide strand. The guide strand binds to complementary mRNAs, and the RISC complex mediates degradation or suppression of the endogenous transcript. The RISC complex will cleave the mRNA when base pair matching is perfectly complementary, or alternatively, the complex can bind the mRNA and suppress translation when there are mismatched base pairs, leaving the mRNA intact. Degradation or suppression of transcripts that code for critical genes in the insect results in decreased amounts of critical gene products and increased mortality. [10,11]

Delivery of intact dsRNA into insect cells remains a challenge, although many delivery methods have been developed [10]. Crops can be genetically engineered to express dsRNA targeting insect pests. The use of modified plants has proven remarkably effective in managing coleopteran pests such as the Colorado potato beetle [4]. Another delivery method is to synthesize the dsRNA in vitro, and then apply to foliage by spraying [12], or to roots by soaking [13], resulting in a transient presence of dsRNA within the plant tissue. Studies have demonstrated that bacteria expressing dsRNA can be heat killed and fed to insects to induce RNAi [14], or can even be fed in a viable state so that the genetically modified bacteria can colonize the gut and deliver dsRNA from within the host [15].

Despite these advances, the prior art fails to show that other microorganisms, such as yeast, are useful as a delivery for vehicle for dsRNA. The present invention addresses these and other needs.

BRIEF SUMMARY OF THE INVENTION

This invention provides methods and compositions for controlling an insect pest. The methods comprise contacting the insect pest with a composition comprising a yeast cell (either killed or living) comprising a nucleic acid encoding a dsRNA molecule which specifically inhibits expression of a target gene in the insect pest, thereby controlling the insect pest. The compositions of the invention are typically present in a lure trap.

The yeast cell can be any yeast capable of transformation and can be, for example, *Saccharomyces cerevisiae*. The insect pest can be, for example, a vinegar fly, such as *Drosophila suzukii*. In those embodiments, yeast cell can be *Hanseniaspora uvarum*.

The target gene can be tubulin, vATPase, blw, RpL19, or acetyl choline esterase. The target sequence in the target gene can be at least about 90% identical to SEQ ID NO: 1, SEQ ID NO: 2, SEQ ID NO: 3, or SEQ ID NO: 4.

The invention also provides expression cassettes comprising a yeast promoter operably linked to a DNA sequence encoding a dsRNA which specifically inhibits expression of a target gene in an insect pest. The yeast promoter can be, for example, a constitutively active TEF1 promoter. In some embodiments, the yeast promoter is an inducible promoter. The target gene can be tubulin, vATPase, blw, RpL19, or acetyl choline esterase. The target sequence in the target gene can be at least about 90% identical to SEQ ID NO: 1, SEQ ID NO: 2, SEQ ID NO: 3, or SEQ ID NO: 4.

Definitions

The terms "nucleic acid," "polynucleotide," and "oligonucleotide" refer to a single or double-stranded polymer of deoxyribonucleotide or ribonucleotide bases read from the 5' to the 3' end. The monomer is typically referred to as a nucleotide. Nucleic acids can include modified nucleotides that permit correct read through by a polymerase and do not significantly alter expression of a polypeptide encoded by that nucleic acid.

The phrase "nucleic acid sequence encoding" refers to a nucleic acid (i.e., DNA) which is the template for transcription of a specific RNA molecule (e.g., a dsRNA) or an mRNA that is translated into a protein. The nucleic acid sequences include both the full length nucleic acid sequences as well as non-full length sequences derived from the full length sequences. A coding sequence can include degenerate codons (relative to the native sequence) or sequences that provide codon preference in a specific host cell.

The term "promoter" refers to regions or sequence located upstream and/or downstream from the start of transcription and which are involved in recognition and binding of RNA polymerase and other proteins to initiate transcription. A "yeast promoter" is a promoter capable of initiating transcription in yeast cells. A yeast promoter can be a nucleic acid sequence originally isolated from a yeast, but promoters not initially isolated from a yeast are also considered "yeast promoters" for the purposes of this disclosure.

An "expression cassette" refers to a nucleic acid construct, which when introduced into a host cell (e.g., a yeast cell), results in transcription of an RNA molecule (e.g., dsRNA or mRNA). An expression cassette typically includes a sequence to be expressed, and sequences necessary for expression of the sequence to be expressed, such as a promoter operably linked to the sequence. Generally, an expression cassette is inserted into an expression vector to be introduced into a host cell.

The term "gene" refers to a segment of DNA involved in producing a protein; it includes regions preceding and following the coding region (leader and trailer) as well as intervening sequences (introns) between individual coding segments (exons). The leader, the trailer as well as the introns include regulatory elements that are necessary during the transcription and the translation of a gene (e.g., promoters, enhancers, etc.). A "gene product" can refer to either the mRNA or protein expressed from a particular gene.

The words "complementary" or "complementarity" refer to the ability of a nucleic acid in a polynucleotide to form a base pair with another nucleic acid in a second polynucleotide. For example, the sequence A-G-T is complementary to the sequence T-C-A. Complementarity can be partial, in which only some of the nucleic acids match according to base pairing, or complete, where all the nucleic acids match according to base pairing.

The terms "protein", "peptide", and "polypeptide" are used interchangeably to denote an amino acid polymer or a set of two or more interacting or bound amino acid polymers. The terms apply to amino acid polymers in which one or more amino acid residue is an artificial chemical mimetic of a corresponding naturally occurring amino acid, as well as to naturally occurring amino acid polymers and non-naturally occurring amino acid polymer.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified.

The terms "identical" or percent "identity," in the context of two or more nucleic acids or proteins of the invention, refer to two or more sequences or subsequences that are the same or have a specified percentage of nucleotides or amino acids that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters, or by manual alignment and visual inspection. See e.g., the NCBI web site at ncbi.nlm.nih.gov/BLAST/. For example, the sequence of a dsRNA of the invention can be compared using the above techniques to the sequence of a target gene in an insect pest, taking into account the presence of uracil in the dsRNA and thymidine in the DNA. Sequences that have at least about 90% sequence identity using the methods described above are said to be "substantially identical." This definition also refers to, and can be applied to, the compliment of a test sequence. The definition also includes sequences that have deletions and/or additions, as well as those that have substitutions. Optimal alignment of such sequences can be carried out by any of the publically available algorithms or programs for determining sequence identity and alignment, e.g., BLAST.

DETAILED DESCRIPTION

This invention provides evidence that genetically modified yeast can be used to produce and deliver dsRNA to an insect pest, such as vinegar flies (members of the genus Drosophila), resulting in altered gene expression and decreased fitness in the insect pest.

Target Insect Nests

The present invention can be used to control any insect pest that will naturally ingest yeast in the environment. For example, yeast is an important endosymbiont and a major component of the microbiome in Drosophila[16]. Yeasts are naturally found growing on the surface of intact and rotting vinegars and produce volatiles that are highly attractive to Drosophilids [17,18]. Palanca et al. quantified the attractive properties of wild yeast isolates and found vinegar associated isolates were more attractive than those not associated with vinegar, regardless of taxonomic positioning [19]. Additionally, they found that Saccharomyces cerevisiae was the most attractive to Drosophila melanogaster. Drosophila acquire yeast from the environment and can transmit yeast horizontally to mates [20] Drosophila-associated yeast spores can be passed intact through the gut and deposited onto food sources [21], where they can be ingested by larvae or adults. Thus, yeast is a chemoattractive, transmittable symbiont of insect pests, such as Drosophila. These characteristics make yeast an ideal and novel candidate to serve as a living biopesticide.

Drosophila suzukii, commonly known as Spotted Wing Drosophila, is an invasive pest of a variety of soft skinned vinegars [22]. Native to South East Asia, this pest was first identified in California in 2008. Since then, infestations have spread across the United States, Canada, and Europe[23], resulting in an estimated 718 million dollars in crop losses annually [24,25]. D. suzukii is sufficiently homologous to the model insect D. melanogaster to facilitate target gene selection. The D. suzukii genome has been sequenced, which further aids in the design of dsRNAs [26]. Additionally, yeast-baited traps have been demonstrated to effectively lure D. suzukii in an agricultural setting[27], and evidence suggests that D. suzukii feed on yeasts in the field[28].

Thus, the present invention is useful for control of Drosophilids (e.g., D. melanogaster, D. suzukii, D. biarmipes, D. takahashii, D. erecta, D. yakuba, D. simulans, D. sechellia, D. ananassae, D. persimilis, D. pseudoobscura, D. willistoni, D. grimshawi, D. virillis, D. subpulchrella, D. biarmipies and D. mojavensis). One of skill will recognize that other insect pests that are symbiotic with yeast can be targeted in a similar manner. A number of examples of insect-yeast symbiosis are known (see e.g., Gonzalez F (2014) Symbiosis between yeasts and insects. Introductory paper at the Faculty of Landscape Architecture, Horiculture, and Crop Production Science. 1-52). Examples of symbiosis between insects and yeast have been characterized in many of the important insect orders, including Hymenoptera (specifically wasps, bees, and ants), Coleoptera (beetles), Hemiptera (aphids and plants hoppers), Lepidoptera (Sigelgaita sp.) and Neuroptera (lacewing).

RNA Interference

RNAi strategies for reducing or inhibiting expression of a target gene are known. RNAi techniques employ genetic constructs that encode double-stranded RNA (dsRNA). Typically, the genetic constructs comprise sense and anti-sense sequences which are placed in regions flanking an intron sequence in proper splicing orientation with donor and acceptor splicing sites. Alternatively, spacer sequences of various lengths can be employed to separate self-complementary regions of sequence in the construct. During processing of the gene construct transcript, intron sequences can be spliced-out, allowing sense and anti-sense sequences, as well as splice junction sequences, to bind forming double-stranded RNA. Alternatively, where secondary structure inhibits splicing machinery, the intron sequences are not spliced out and the dsRNA is supplied as a hairpin structure. When the dsRNA is expressed in a cell, as noted above, ribonucleases bind to and cleave the double-stranded RNA, thereby initiating the cascade of events leading to degradation of the target mRNA molecules, and thereby silencing target genes. The phenomenon of RNA interference is described in Bass, Nature 411: 428-29 (2001); Elbahir et al., Nature 411: 494-98 (2001); and Fire et al., Nature 391: 806-11 (1998); and WO 01/75164, where methods of making interfering RNA also are discussed.

For example, to reduce expression of a target gene in an insect pest using RNAi, an expression cassette encoding a double-stranded RNA having the sequence of an mRNA transcribed from the target gene, or a substantially identical sequence (including those engineered not to translate the protein), or fragment thereof, is introduced into a yeast cell. The resulting yeast cell can then be fed to the insect pest to determine its ability to inhibit expression of the target gene and/or inhibit growth of the insect pest.

The RNAi polynucleotide can hybridize with the full-length mRNA encoded by the target gene or hybridize to a fragment of the target RNA or DNA (the target sequence). The target sequence will typically be at least about 10, 15, 20, 50 or 100 nucleotides in length, but usually comprise less than about 500 nucleotides. Often, the target sequence and/or the dsRNA sequence is between about 50 and about 400 nucleotides in length, usually between about between 100 and about 300 nucleotides.

Although the sequence of the dsRNA used for RNAi need not be completely identical to the target sequence of the target gene, it is typically substantially identical, e.g., at least 70%, 80%, 90%, 95%, 98%, or more identical to the target sequence.

Target genes can be selected based any of a number of criteria. Such criteria include for example: gene essentiality, midgut expression level, degree of divergence from related species sequences, and target effectiveness demonstrated in previous studies. In the case of Drosophilids, suitable target genes include, for example, y-tubulin 23C. blw. Ace, RpL19 and acetylcholine esterase. Suitable target genes for *D. suzukii* can be identified in the Spotted Wing Flybase (see, spottedwingflybase.oregonstate.edu). Suitable RNAi targets for three insect species: *D. suzukii, Halyomorpha halys* (brown marmorated stink bug), and *Leptinotarsa decemlineata* (Colorado potato beetle) are provided in the sequence listing. Other suitable targets include B actin for Colorado potato beetle, V-ATPase for western corn rootworm, and hunchback for the pea aphid (*Acrythosiphon pisum*).

In addition to RNAi, other inhibitory RNA techniques are known. For instance, antisense technology can be conveniently used to inactivate gene expression. To accomplish this, a nucleic acid segment from the desired gene is cloned and operably linked to a promoter such that the antisense strand of RNA will be transcribed. The expression cassette is then introduced in the yeast cell and the antisense strand of RNA is produced (see e.g., Sheehy et al., *Proc. Nat. Acad Sci. USA,* 85:8805-8809 (1988); Pnueli et al., *The Plant Cell* 6:175-186 (1994); and Hiatt et al., U.S. Pat. No. 4,801,340).

Catalytic RNA molecules or ribozymes can also be used to inhibit expression of a target gene. Ribozymes that specifically pair with a target RNA and cleave the phosphodiester backbone at a specific location can be designed to functionally inactivating the target mRNA. In carrying out this cleavage, the ribozyme is not itself altered, and can cleave other molecules, making it a true enzyme. The inclusion of a ribozyme sequence in an antisense RNA confers RNA-cleaving activity, thereby increasing the activity of a given antisense construct. The design and use of target RNA-specific ribozymes is described in Haseloff et al. *Nature,* 334:585-591 (1988).

Another method of suppression is sense suppression (also known as co-suppression). Introduction of expression cassettes in which a nucleic acid is configured in the sense orientation with respect to the promoter has been shown to be an effective means by which to block the transcription of target genes. For an example of the use of this method to modulate expression of endogenous genes (Napoli et al., *The Plant Cell* 2:279-289 (1990); Flavell, *Proc. Natl. Acad. Sci., USA* 91:3490-3496 (1994); Kooter and Mol, *Current Opin. Biol.* 4:166-171 (1993); and U.S. Pat. Nos. 5,034,323, 5,231,020, and 5,283,184).

Production of Transgenic Yeast Cells

Production of recombinant yeast cells is well known. Yeast species of interest in the present invention include *Saccharomyces cerevisiae, Pichia pastoris,* and *Hanseniaspora uvarum, H. uvarum* has been isolated as the most common yeast species in the gut of *D. suzukii* and is particularly useful for control of this species. Suitable promoters for expression in yeast are also well known and include, for example, the bacteriophage T7 promoter, promoters from GAL1 (which is induced by the presence of galactose), ADH1, the TEF1 promoter and the AOX promoter (an methanol inducible promoter) and the like. Many yeast cloning vectors have been designed and are readily available. Methods for transforming *S. cerevisiae* cells with exogenous DNA and producing recombinant products polypeptides are also well known. Transformed cells are selected by phenotype determined by a selectable marker, commonly drug resistance or the ability to grow in the absence of a particular nutrient (e.g., leucine).

In addition, in some embodiments, auxotrophic yeast strains are used. Use of these strains relies on marker genes that encode key enzymes in various essential metabolic pathways. Examples include the URA, HIS3, LEU2, TRP1, and MET15 marker genes which encode essential enzymes for de novo synthesis of pyrimidines, 1-histidine, 1-leucine, 1-tryptophan, and 1-methionine, respectively. Yeast strains are auxotrophic for the nutrient in question due to the absence of a functional chromosomal copy of the marker gene. The auxotrophic yeast strains can thus be propagated only in media that contain the appropriate nutrients.

Alternatively, synthetic auxotrophs can be engineered to require particular compounds. For example, bacteria have been engineered to be viable only in the presence of the synthetic molecule benzothiazole[39], which prevents genetically modified bacteria from escaping and increases biosafety. This technology could be applied to yeast biopesticides to prevent unwanted escapes.

Lure Traps

Lure traps are commonly used to attract and kill insect pests. Design and use of such traps are well known to those of skill in the art. A lure trap of the invention can be any device into which the recombinant yeast of the invention are placed, and that prevents the insect pest from escaping once the insect pest has come into contact with the trap. The traps can be of various sizes, shapes, colors, and materials. Traps of the present invention can be designed and manufactured specifically for use as an insect trap, or can be a container converted and adapted from other uses such as, for example, a glass Petri dish, a metal coffee can, a cardboard box, or any ordinary plastic, metal, fiberglass, composite or ceramic container.

Considerable research has been directed at determining the natural volatile compounds that attract vinegar flies to their hosts, and incorporating them into lures for commercial traps. For example, yeast have been incorporated into lure traps for vinegar flies (see e.g., U.S. Pat. No. 8,940,287). Such a trap may comprise yeast in combination with a growth medium (e.g., sugar and water). The growth medium can also include chemicals or nutrients necessary to induce expression of the dsRNA in transformed yeast cell. The trap may also comprise dried or fresh vegetable matter.

EXAMPLE

The following example is offered to illustrate, but not to limit the claimed invention.

Materials and Methods

Animal Models

For all insect bioassays, the researcher was blinded from the identity of the treatment during the course of the experiment. Insects were assigned to treatment groups by pooling same aged individuals from several rearing bottles and randomly redistributing into groups. A different generation of flies was used in each experimental replicate.

Fly Strains and Rearing

All *Drosophila* species and strains tested in our studies as well as their collection sites are Table 1. All lines were maintained in Fisherbrand square, polyethylene, 6 oz. stock bottles (Fisher Scientific. Pittsburgh, Pa.) containing 50 ml of Bloomington stock center *Drosophila* food recipe. Colonies were kept between 22° C. to 25° C. in a cabinet incubation chamber (Percival Scientific, Inc., Perry, Iowa) with a 12:12 h light:dark cycle.

TABLE 1

*Drosophila* strains

| Species | Strain | Location of collection |
|---|---|---|
| D. suzukii | Mixed Watsonville population | Watsonville, CA |
| D. biarmipies | genome strain, 361.0-isol e-11 | Ari Ksatr, Cambodia |
| D. melanogaster | Oregon R | Roseburg, Oregon |
| D. simulans | W501 | Genome Strain |

Target Gene Selection for Double Stranded RNA (dsRNA) Knockdown

Target genes were selected based on four main criteria: gene essentiality, midgut expression level, degree of divergence from related species sequences, and target effectiveness demonstrated in previous studies. We assumed that genes with essential functions in *D. melanogaster* would also have essential functions in *D. suzukii*. Genes with lethal null phenotypes recorded in Flybase.org were considered essential. We hypothesized that the dsRNA produced by the yeast would be absorbed by the midgut tissues in the fly, so we selected target genes that are expressed in the adult and larval midgut. Midgut expression was determined using the FlyAtlas database of microarray data [44]. Conservation of target sequences between species was also considered when selecting gene fragments. The *D. suzukii* y-tubulin 23C target sequence was designed to be highly divergent from members of the *melanogaster* subgroup by targeting the 3' untranslated region (UTR). The blw, Ace, and RpL19 target sequences were chosen from coding regions and are more conserved across species. Alignments of target gene sequences for *D. suzukii, D. biarmipes, D. melanogaster,* and *D. simulans* and identity scores (Table 2) were generated with ClustalW2 [45]. Previous studies have implicated tubulin as an effective RNAi target in coleopteran pests [32]. dsRNA targeting blw and RpL19 caused increased cell death in *D. melanogaster* tissue culture experiments [46], so we selected homologous target gene fragments from *D. suzukii* sequences. Chemical pesticides commonly disrupt neurotransmission by inhibiting the function of acetylcholine esterase, so we chose to target this gene as well. Target gene fragment sequences are listed in the sequence listing. Spotted Wing Flybase accession numbers were used as identifiers and sequences can be retrieved from Spotted Wing Flybase (see, spottedwingflybase.oregonstate.edu).

TABLE 2

Sequence conservation of target gene fragments

| gene | species | identity | longest match | NCBI accession |
|---|---|---|---|---|
| bellwether | D. biarmipies | 99% | 130 bp | KB462602 |
| bellwether | D. melanogaster | 96% | 42 bp | NM_166554 |
| bellwether | D. simulans | 95% | 50 bp | CM002911 JPYS01000000 |
| y-tubulin 23C | D. biarmipies | 90% | 47 bp | KB462641 AFFD02000000 |
| y-tubulin 23C | D. melanogaster | 76% | 15 bp | NM_057456 |
| y-tubulin 23C | D. simulans | 74% | 16 bp | XM_002077929 CM002910 |

Construction of Vectors for In Vitro Synthesis of dsRNA

1 µg of *D. suzukii* total RNA was used to synthesize cDNA using ThermoScript RT-PCR System (Life Technologies, Grand Island, N.Y.) according to the manufacturer's protocol. Target gene fragments y-tubulin 23C and Vacuolar H+-ATPase 26 kD subunit were PCR amplified from *D. suzukii* total cDNA using AccuPrime Taq DNA Polymerase (Life Technologies, Grand Island, N.Y.) following manufacturer's specifications and ligated into pCR2.1 using The TA Cloning Kit (Life Technologies, Grand Island, N.Y.). The primer sequences used for molecular cloning are listed in Table 3. The T7 promoter sequence (5'-TAATACGACT-CACTATAGG-3') was added to the 5' end of the forward and reverse primer sequences.

In Vitro RNA Synthesis

Target gene fragments y-tubulin 23C and vacuolar H+-ATPase 26 kD subunit were PCR amplified from pCR2.1 vectors containing the target sequences and convergent T7 promoters. PCR products were purified with the QiaQuick PCR Purification Kit (Qiagen, Valencia, Calif.). Purified PCR product was used as template for in vitro transcription using the MEGAscript T7 Transcription Kit (Life Technologies, Grand Island, N.Y.) following manufacturer's instructions.

Construction of Plasmid Vectors for Expression of dsRNA in Yeast

Yeast expression vectors containing inverted repeats of ~200 bp *D. suzukii* target gene sequence joined by a 74 bp intron sequence from the *D. melanogaster* white gene were constructed in two cloning steps. The intron and the target sequence were inserted in the forward orientation in the first step, and the target sequence was inserted in the reversed orientation in the second step. Target gene fragments y-tubulin 23C, bellwether, acetylcholine esterase, and ribosomal protein L19 were PCR amplified from *D. suzukii* total cDNA using AccuPrime Taq DNA Polymerase (Life Technologies, Grand Island, N.Y.) following manufacturer's specifications. A BamHI restriction site was added to the 5' end of the forward primer sequence, and a EcoRI restriction site was added to the 5' end of the reverse primer sequence (see Table 3 for primer sequences). The second intron of the white gene was PCR amplified from *D. melanogaster* total cDNA using primers with a BamHI restriction site added to the 5' end of the forward and a EcoRI site added to 5' end of the reverse primer. PCR products were purified with the QiaQuick PCR Purification Kit (Qiagen, Valencia, Calif.) and target sequences were digested with restriction enzymes BamHI and XbaI, and the white intron was digested with BamHI and EcoRI (New England Biolabs, Ipswitch, Mass.). The *S. cerevisiae* expression vector p406TEF1 (Addgene, Cambridge, Mass.) was digested with XbaI and EcoRI. Digested PCR products and vector DNA were purified with gel electrophoresis and the QiaQuick Gel extraction kit following manufacturer's instructions. The vector, target sequence, and intron were ligated together with T4 DNA ligase (New England Biolabs, Ipswitch, Mass.). Ligation products were transformed into *E. coli* and plasmid DNA was extracted from the clones. Sequencing was performed to confirm presence of the forward target sequence and the intron. Target gene fragments were amplified from the confirmed DNA clones using a reverse primer with EcoRI on the 5' end and a forward primer with HindIII on the 5' end. Confirmed DNA clones were restriction digested with EcoRI and HindIII. Digested PCR products and DNA vectors were gel purified and ligated together with T4 DNA ligase. The complementary sequences in the completed vectors created secondary structure that prevented Sanger sequencing, so completed clones were restriction digested with XbaI and EcoRI, or BamHI and HindIII, and gel purified digestion products were used for sequencing for confirmation of successful expression vector construction.

Transformation of Plasmids into *S. cerevisiae*

DNA vector p406TEF1 containing inverted repeats of *D. suzukii* target gene sequence were transformed into *S. cerevisiae* strain INVSc1 (Life Technologies, Grand Island, N.Y.) using the Frozen EZ Yeast Transformation kit II (Zymo, Irvine, Calif.) following manufacturer's instructions. Transformants were selected on minimal media without uracil and confirmed by colony PCR. PCR reactions were performed as described above with a forward primer located upstream of the multiple cloning site and the reverse primer located within the white intron.

Isolation of RNA from Yeast 1.5 mL liquid yeast culture was pelleted at 12,000 rpm for 1 minute. 300 µl of TRI-reagent (Sigma Aldrich, St Louis, Mo.) was added to the pellet and homogenized by vortexing with 100 µl acid-washed 425-600 µm glass beads (Sigma Aldrich, St Louis, Mo.). One-fifth volume of 100% chloroform was added to each sample and incubated at room temperature for 10 minutes. Samples were spun down at 13,000 rpm for 15 m 390 minutes at 4° C. The upper aqueous layer was collected and nucleic acid was precipitated by adding an equal volume of 100% isopropanol and incubated at room temperature for 10 minutes. Samples were spun down at 13,000 rpm for 15 minutes at 4° C., and pellets were washed once with two volumes of 70% ethanol. Pellets were resuspended in 20 µl 1× Turbo DNase buffer (Life Technologies, Grand Island, N.Y.) and treated with 1 ul Turbo DNase following manufacturer's instruction. RNA concentrations were quantified with a NanoDrop 2000 Spectrophotometer (Fisher Scientific, Pittsburgh, Pa.).

Treatment of Larvae with In Vitro Transcribed dsRNA

2nd instar larvae were separated from fly food and rinsed with water. 100 µl of a solution containing 1 mg/ml in vitro transcribed dsRNA, 3% Lipofectamine 2000 (Life Technologies, Grand Island, N.Y.), and Schneider's *Drosophila* medium (Life Technologies, Grand Island, N.Y.) was pipetted onto a plastic dish forming a droplet. 10 larvae were gently added to each droplet and soaked for 1 hour. Larvae were returned to a small dish of fly food and mortality was assessed 24 hours later and at the time of eclosion, or larvae were collected for RNA isolation at the same time-point when mortality was assessed.

Yeast Feeding Assay for Adults and Larvae

Yeast colonies expressing dsRNA were incubated in 4 ml minimal media without uracil at 30° C., and 225 rpm for 24 hours. 4 ml cultures were used to inoculate 300 ml cultures and incubated at 30° C. for 24 hours. Liquid culture was pelleted at 5,000 rpm for 15 minutes. To feed larvae, pelleted yeast was mixed with standard Bloomington *Drosophila* fly food medium at a ratio of 1:1 by weight and fed to larvae in 12-well tissue culture plates. After yeast feeding period, larvae were transferred to a vial containing standard Bloomington *Drosophila* medium to grow to adulthood, or were collected for RNA isolation. To feed adults, pelleted yeast was spread thinly on a wooden tongue depressor coated in YPD agar (Sigma Aldrich, St Louis, Mo.). The yeast-covered tongue depressor was imbedded upright in a vial containing standard Bloomington *Drosophila* medium and 30 adult flies were added to each vial. To confirm the adults and larvae ingest the yeast, red food coloring was added to the liquid yeast culture (McCormick), and midguts were dissected and inspected visually under a light microscope.

Activity Monitoring

Male adult flies were loaded individually into glass tubes for activity monitoring using *Drosophila* Activity Monitoring System (DAMS) (Trikinetics, Waltham, Mass.) following three days of yeast feeding treatment. The glass tubes were filled at one end with media containing 5% agar and 2% sucrose by weight. Percival incubators were set to 25° C. with a photoperiod of 12 hours of light and 12 hours of dark. Fly activity monitoring using DAMS and data analysis using FaasX were as previously described 47427

Assessment of Fecundity and Viability of Offspring

Standard Bloomington *Drosophila* medium was dyed green with food coloring (McCormick) to provide visual contrast to eggs. 1 ml hot media was pipetted onto a small plastic spoon and allowed to cool. Once solidified, media was painted with a thin layer of wild type *S. cerevisiae* grown in liquid culture to encourage oviposition. Spoons were placed inside empty fly vials (Genesee Scientific, San Diego, Calif.) and one male and one female were added to the vial. After the egg-laying period, eggs were counted visually under a stereomicroscope. The spoon was transferred to a vial containing *Drosophila* medium and eggs were allowed to grow to adulthood.

Isolation of RNA from Adult and Larval Midgut

Following yeast feeding treatment, live adults were anesthetized with carbon dioxide and live larvae were separated from yeast mixture. Adults and larvae were transferred to a microcentrifuge tube containing TRI-reagent (Sigma Aldrich, St Louis, Mo.) and kept on ice. Dissection of the midgut was performed immediately on ice in chilled RNAlater (Life Technologies, Grand Island, N.Y.). Midguts were washed 2× in chilled nuclease-free water and 300 µl TRI-reagent was added to the microcentrifuge tube. Midguts were homogenized by grinding using a motorized pestle and RNA isolation was performed as described above in yeast RNA isolation.

Quantitative Real-Time PCR (qRT-PCR)

1 µg of total RNA was used to synthesize cDNA using ThermoScript RT-PCR System (Life Technologies, Grand Island, N.Y.) according to the manufacturer's protocol. Dilutions (1:10) of cDNA samples were used in qRT-PCR reactions. Gene-specific primers were designed based on sequence analysis using the *D. suzukii* genome scaffold and optimized at an annealing temperature of 63.3° C. Melt curve and BLAST analysis were used as criteria to determine primer specificity. The qRT-PCR assays were performed using SsoAdvanced SYBR Green Supermix (Bio-rad, Hercules, Calif.) in a CFX96 Touch Real-Time PCR Detection thermal cycler (Bio-Rad, Hercules, Calif.). Cycling conditions were 95° C. for 30 seconds, 40 cycles of 95° C. for 5 seconds, followed by an annealing/extension phase at 63.3° C. or 55° C. for 30 seconds. The reaction was concluded with a melt curve analysis going from 65° C. to 95° C. in 0.5° C. increments at five seconds per step. Three technical replicates were performed for each data point of each biological replicate, and at least 4 biological replicates were performed for analysis of each gene. Data were analyzed using the standard ΔΔCt method and target gene mRNA expression levels were normalized to the reference gene Cbp20 mRNA levels. Finally, average relative expression values for treated samples were divided by the average control values to represent the fold change of target gene expression in the treated sample.

Results

Figure 1:
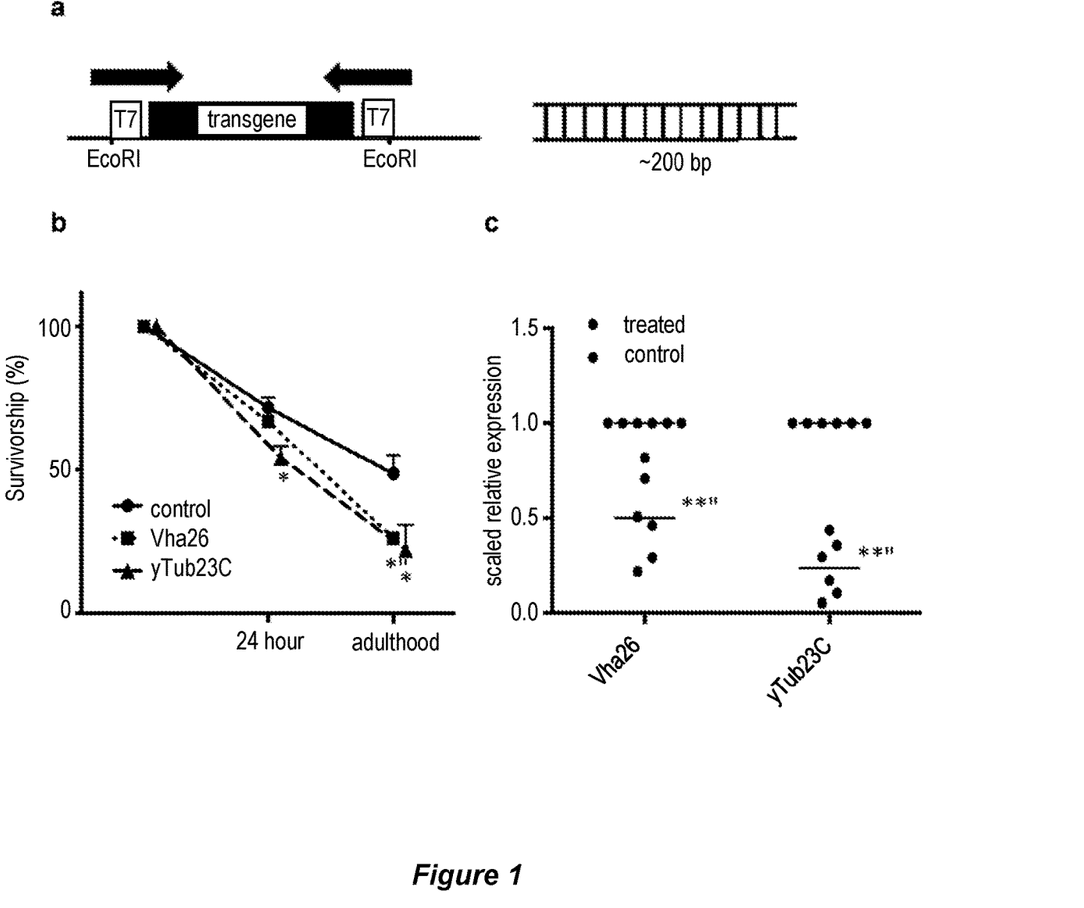
FIGS. 1a to 1c show that D. suzukii larvae treated with in vitro transcribed dsRNA have increased mortality and decreased target gene expression. (a) Map of vector for in vitro transcription of dsRNA using convergent T7 promoters flanking ~200 bp of D. suzukii target gene sequence. Black arrows indicate direction of transcription. (b) Survivorship of 2nd instar larvae following soaking treatment with dsRNA solution. Mortality was assessed 24 hours after treatment and at the time of eclosion. A total of 160 larvae were tested in each treatment, and data represent mean and s.e.m. of three independent experiments. (c) Suppression of target genes yTub23C and Vha26 in whole larvae 24 hours after treatment with dsRNA solution. Ten larvae were homogenized to obtain one RNA sample. Expression was quantified with RT-qPCR and normalized against housekeeping gene Cbp20. Each data point represents a biological replicate, and horizontal lines indicate the mean. (b) and (c) Asterisks represent significance as determined by two-tailed t-test (* indicates $p<0.05$, and ** indicates $p<0.01$).
Figure 2:
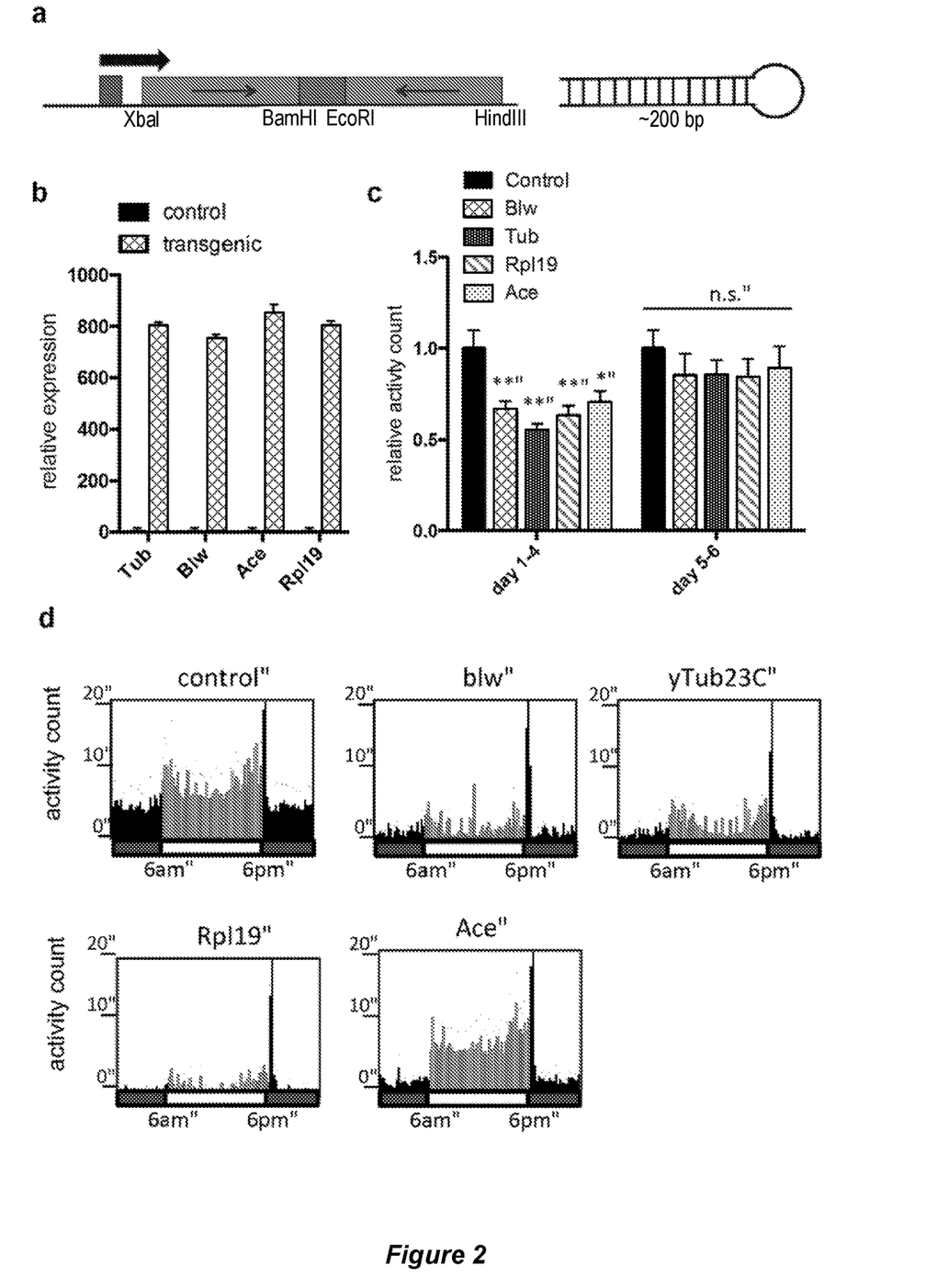
FIGS. 2a to 2d show that D. suzukii adults fed on yeast expressing dsRNA have decreased locomotor activity levels. (a) Map of transformation vector for expression of hairpin dsRNA in S. cerevisiae. ~200 bp of D. suzukii target gene sequence was inserted into p406TEF1 to form inverted repeats linked by 74 bp of intron sequence from the white gene. Black arrow indicates direction of transcription. (b) Expression of dsRNA in S. cerevisiae. Expression was quantified with RT-qPCR and was normalized against housekeeping gene actin. Data represent mean and s.e.m. of three technical replicates. (c) Locomotor activity levels in D. suzukii following a three day treatment with yeast expressing dsRNA targeting D. suzukii blw, yTub23C, Ace, and RpL19. Male adult flies were fed ad libitum with a choice between artificial diet and live yeast for three days. Activity was recorded for 6 days after the feeding period using the DAMS. The first through the fourth days of recording were averaged together, and days 5 and 6 were averaged. Data represent mean and s.e.m. of 3 independent experiments, and a total of 96 flies were tested per treatment. Each experiment was normalized to the average of the control treatment. One-way ANOVA was performed ($p=0.0009$) and significance relative to the control was determined by post hoc Bonferroni corrected t-test (* indicates $p<0.05$ and ** indicates $p<0.01$). (d) Activity levels plotted over the second day of recording following three days of feeding treatment. Each bar represents average activity counts in 15-minute increments. Black bars indicate lights off and grey bars represent lights on. Each eduction graph represents an average of 32 flies in one experiment. Representative eduction graphs are shown here.

Treatment of Larvae with In Vitro Transcribed dsRNA Reduces Expression of Target Genes and Decreases Survival to Adulthood Previous studies have demonstrated dsRNA can be synthesized and fed to insects in solution or artificial diet, resulting in gene knockdown and mortality [1,29-31]. This method is often used to select targets for in vivo testing. Critical genes tubulin and vacuolar ATPase are commonly used target genes and have effectively induced mortality in coleopterans [32]. First, we examined whether dsRNA targeting y-tubulin 23C (yTub23C) and vacuolar H+ ATPase 26 kD subunit (Vha26) could be used to induce mortality in D. suzukii larvae. dsRNA was transcribed in vitro using a plasmid containing approximately 200 bp D. suzukii target gene sequence flanked with convergent T7 promoters (FIG. 1a). We found that a one-hour soaking treatment with in vitro transcribed dsRNA reduced survival to adulthood by 54% and 46% respectively (FIG. 1b). Next, we asked if the increased mortality was due to changes in target gene expression level. RNA was extracted from whole larval bodies 24 hours after the one-hour soaking treatment. Target transcripts yTub23C and Vha26 were reduced by 76% and 50% respectively in treated samples (FIG. 1c). These results suggest dsRNA in the soaking solution is absorbed and able to trigger an RNAi response in the larvae, resulting in mortality.

dsRNA Targeting Critical D. suzukii Genes is Expressed in Modified Saccharomyces cerevisiae DNA plasmids were constructed to constitutively express dsRNA hairpins targeting D. suzukii critical genes. Approximately 200 bp D. suzukii target gene sequence was inserted into a DNA plasmid to formed inverted repeats joined by 74 bp of intron sequence from the white gene from D. melanogaster (FIG. 2a). This plasmid is self-replicating and does not integrate into the host genome, so the host genome remains unchanged. Plasmids were transformed into S. cerevisiae strain INVSc1 using heat shock and expression of dsRNA was verified using RT-qPCR (FIG. 2b). Empty P406TEF1 plasmid was transformed to use as a control strain. As a control for dsRNA treatments, some studies use dsRNA targeting a gene from another species, such as GFP. We chose to use a yeast that contains empty plasmid and expresses no dsRNA as the control strain to avoid possible off target effects, such as suppression of critical genes that may have regions of sufficient homology to the control sequence to bring about an RNAi response [33].

D. suzukii Adults Fed on Yeast Expressing dsRNA have Decreased Locomotor Activity Levels Adult D. suzukii males were fed ad libitum for three days with a choice between standard Drosophila artificial diet and live yeast growing on solid agar. To verify that the flies consumed the yeast, yeast were grown with red food coloring and midguts were dissected and examined after feeding. When fed on live yeast expressing dsRNA targeting bellwether (blw), Ribosomal protein L19 (RpL19), acetylcholine esterase (Ace), and yTub23C, adult D. suzukii had decreased locomotor activity in the 4 days following treatment (FIG. 2c). The rationale for selection of these target genes is stated in the methods section. Although activity levels were reduced in flies treated with dsRNA, flies in all treatments maintained typical temporal patterns of activity through the day (i.e. anticipation of dawn and dusk, and peak of activity at dusk) (FIG. 2d). We found this effect on locomotor activity level persisted over the first four days following the feeding period, but the activity levels of the treated flies were not significantly different from the control flies by the fifth or sixth day following the feeding period (FIG. 2c). This result indicates the treated flies were able to recover from the dsRNA treatment.

Figure 3:
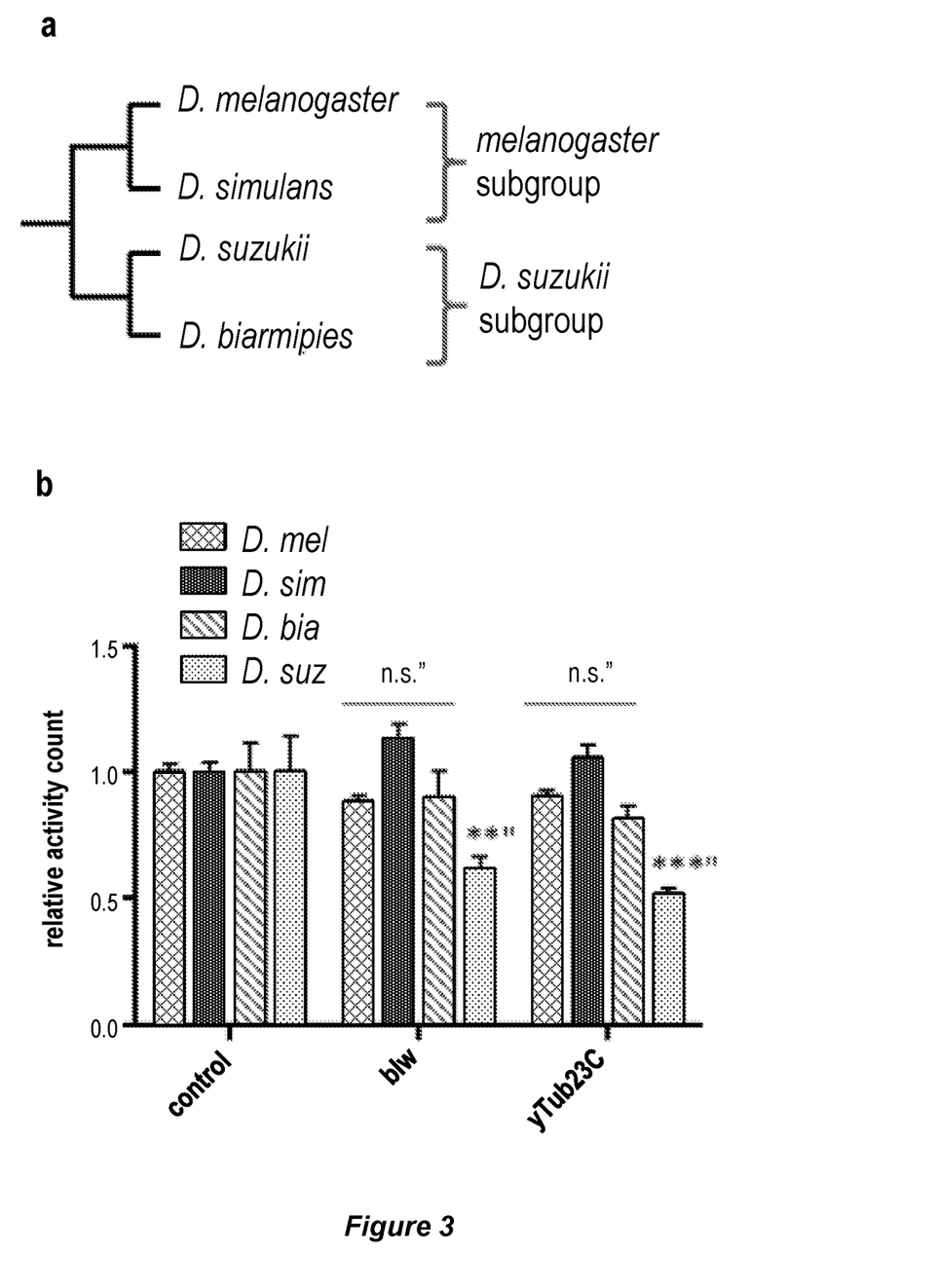
FIGS. 3a to 3c show that the effects of yeast feeding treatment on adult activity levels are species specific. (a) Cladogram of melanogaster and suzukii subgroups. Only the tested species were included in the cladogram. (b) Relative locomotor activity levels in D. suzukii, D. melanogaster, D. simulans, and D. biarmipes following a three-day treatment with yeast expressing dsRNA against bellwether and yTub23C. Activity was recorded using the DAMS during the 4 days following the treatment. Data represent averages and s.e.m. of 3 independent experiments, and a total of 96 flies were tested per treatment. Each replicate was normalized to the average of the control treatment. Two-way ANOVA was performed ($p=0.0001$) and significance relative to the control was determined by post hoc Bonferroni corrected t-test ( indicates $p<0.01$, and * indicates $p<0.001$). (c) Activity levels plotted over the second day of recording following three days of feeding treatment. Each bar represents average activity counts in 15-minute increments. Black bars indicate lights off and grey bars indicate lights on. Each eduction graph represents an average of 32 flies in one experiment. Representative eduction graphs are shown here.

The Effects of Yeast Feeding Treatment on Adult Locomotor Activity Levels are Species Specific The benefit of using RNAi in pest management is that RNAi triggers can be designed to target pest species, but not beneficial insects. To demonstrate this, we fed yeast expressing dsRNA to other Drosophilids and found that even closely related species were unaffected by the treatment (FIG. 3b), D. biarmipes is closely related to D. suzukii, while D. melanogaster and D. simulans and more distant relatives (FIG. 3a), D. simulans, D. biarmipes, and D. melanogaster were unaffected by treatment with yeast expressing dsRNA targeting blw and yTub23C. All species maintained regular temporal patterns of activity throughout the day (FIG. 3c). Homologous gene target gene fragments were identified for each species by BLAST sequence alignment [34], and sequence identity scores were calculated (Table 1). The blw target gene fragment was designed to be highly conserved, with 95% to 99% conservation between D. suzukii and the other Drosophila species. Surprisingly, closely related D. biarmipes did not have significantly reduced activity, despite 130 consecutive matching base pairs in the target gene fragment, D. melanogaster and D. simulans have 42 and 50 consecutive matching base pairs to the blw fragment, respectively. The yTub23C target gene fragment was designed to be divergent by targeting the 3' untranslated region and is 90% to 74% conserved. We predicted the yTub23C fragment would be less effective on species other than D. suzukii due to reduced base pair matching. The lack of an effect on activity in species other than D. suzukii suggests that a high degree of perfect base pair matching is required to reduce locomotor activity. These results imply the mechanism responsible for this reduction in activity level is target sequence dependent. Alternatively, it is possible that blw is sufficiently conserved in other species to be susceptible to RNAi, but there are different regulatory mechanisms in other species that can better compensate for the knockdown of this critical gene. Another alternative explanation for the differences in activity level between species following treatment could be that the dosage varies by species, since the feeding assay was conducted ad libitum.

Figure 4:
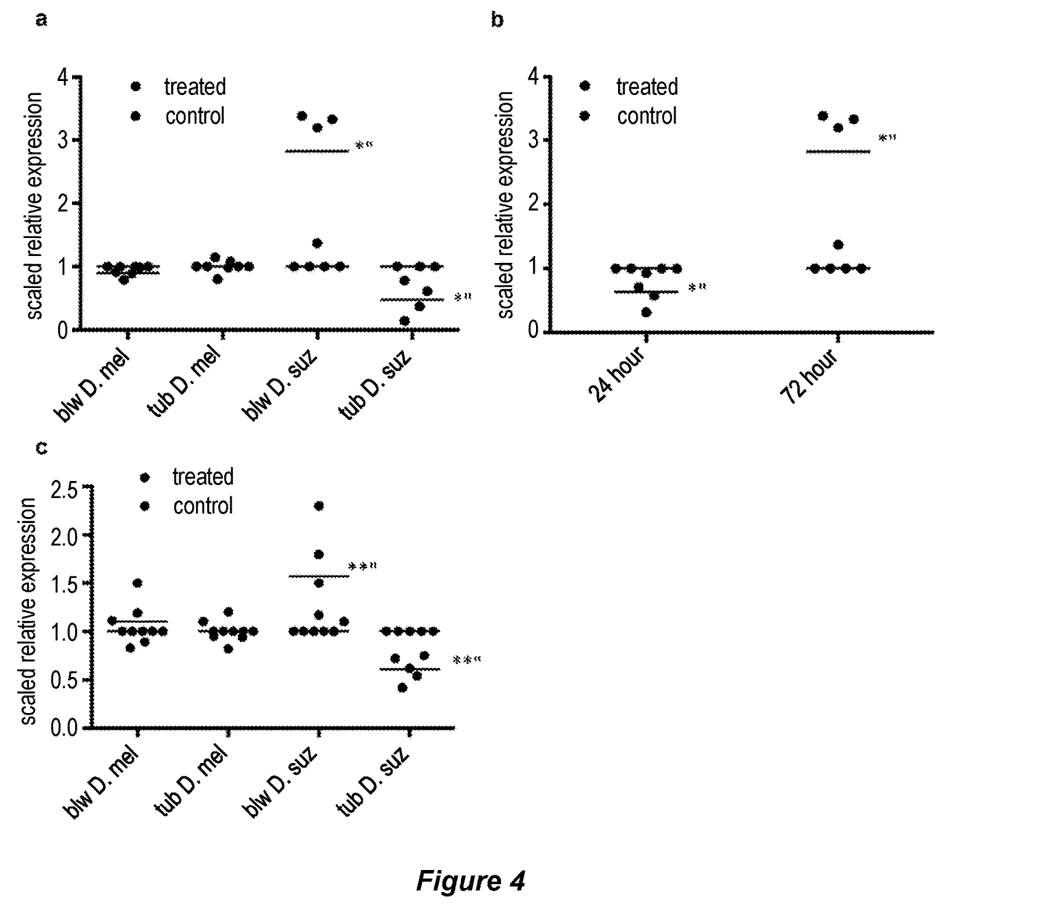
FIGS. 4a to 4c show that altered target gene expression in midgut following yeast feeding treatment. Relative expression of target genes bellwether and y-tubulin 23C in (a) adult midgut and (c) larval midgut following three days of treatment with yeast expressing dsRNA. (b) Relative expression in larval midgut of target gene blw following 24 and 72 hours of treatment with yeast expressing dsRNA. Ten midguts were dissected and homogenized to obtain one RNA sample. Expression was quantified with RT-qPCR and was normalized against housekeeping gene CBP20. The expression level in the control is scaled to one and treated expression levels are plotted relative to the control. Each data point represents one biological replicate and the horizontal line indicates the mean. For (a) and (b) n=4, and (c) n=5. Two-way ANOVA was performed and significance relative to the control was determined by post hoc Bonferroni corrected t-test (* indicates p<0.05, and ** indicates p<0.01).

Ingestion of Yeast Biopesticide Alters Expression Level of Target Genes with Species Specificity RNAi is not systemic in Drosophila, meaning RNAi only occurs within cells that contain dsRNA 35. The midgut is the only portion of the alimentary tract that is not keratinized and is thought to be the main site of dsRNA absorption, so we examined the midgut tissues post treatment to measure changes in target gene expression in adults and larvae, D. suzukii larvae fed on yeast expressing dsRNA targeting yTub23C for 72 hours had reduced yTub23C mRNA levels in the midgut, and larvae fed on yeast targeting blw had significantly increased expression of blw (FIG. 4a). Although RNAi directly reduces target transcript levels through cleavage and degradation, previous studies have demonstrated that compensatory mechanisms can cause upregulation of target genes following an RNAi response[36]. To determine if this was the case, we measured blw expression after 24 hours of treatment with yeast targeting blw and found that expression is decreased after 24 hours (FIG. 4b). This result suggests knockdown of blw is occurring soon after initial yeast exposure, and over several days, a compensatory mechanism causes increased expression of the target gene. Adult D. suzukii midgut gene expression following yeast treatment was similar to the results in larvae, i.e. blw expression was elevated following treatment, and γTub23C was decreased (FIG. 4c). We did not find significant changes in target gene expression in D. melanogaster larva or adult midguts following 72 hour yeast feeding treatments (FIG. 4a, 4b). The lack of change in target gene expression in D. melanogaster was not surprising, since we also saw no changes in locomotor activity. These observed changes in target gene expression in D. suzukii but not D. melanogaster indicate precise target gene sequence matching is required to elicit an RNAi response. Moreover, larvae were subjected to a no-choice feeding assay, so differences in gene expression between D. suzukii and D. melanogaster larvae are not dependent on dosage.

Ingestion of Yeast Biopesticide Reduces Reproductive Fitness.

Figure 5:
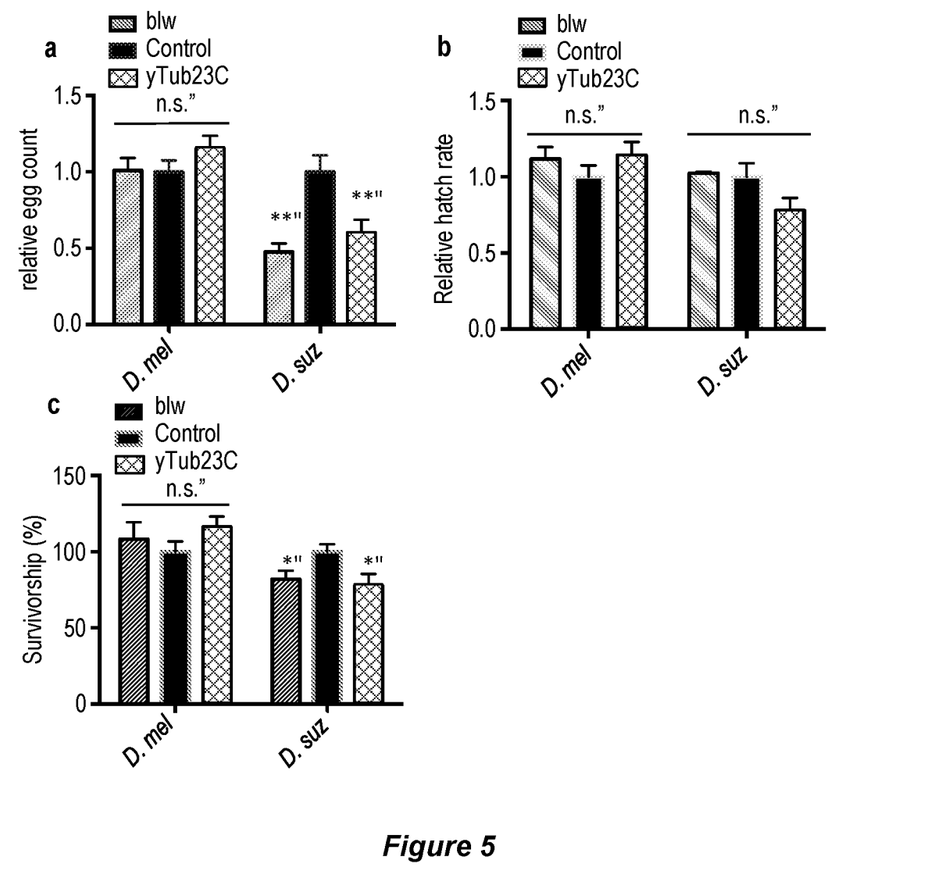
FIGS. 5a to 5c show that yeast feeding treatment of adults and larvae decreases larval survivorship and adult reproductive fitness with species specificity. (a) Relative egg counts of D. melanogaster and D. suzukii. Virgin females and males were fed separately on yeast expressing dsRNA against blw and yTub23C for three days. One male and one female were crossed and allowed to lay eggs for 48 hours (D. melanogaster) or 72 hours (D. suzukii). (b) Relative hatch rate of D. melanogaster and D. suzukii eggs when parents were fed as described in (a). The hatch rate was determined by dividing the number of adults by the number of eggs recorded in that vial. Data shown in (a) and (b) represent mean and s.e.m. of three independent experiments and a total of 75 females were tested per treatment. Each replicate was normalized to the mean of the control. Two-way ANOVA was performed and significance relative to the control was determined by post hoc Bonferroni corrected t-test (** indicates p<0.01). (c) Survivorship of D. melanogaster and D. suzukii 2nd instar larvae following 24 hour treatment with live yeast expressing dsRNA against blw and yTub23C. Larvae were fed on a mixture containing 50% artificial diet and 50% live-pelleted yeast by volume. Mortality was assessed at the time of eclosion. Data shown in (c) represent mean and s.e.m. of six independent experiments and a total of 300 larvae were tested per treatment. Each replicate was normalized to the mean of the control and significance relative to the control was determined by a two-tailed t-test (* indicates p<0.05).

Decreased reproductive fitness of an insect pest can reduce the population size within a region, minimizing crop losses. To test if the yeast treatment affects reproductive fitness, we counted the number of eggs deposited per female post-treatment and measured the survival rate of the offspring. We found that yeast expressing dsRNA that targets blw and γTub23C caused significant decrease in the number of eggs laid by D. suzukii, but not by D. melanogaster (FIG. 5a). One explanation of this result is that induction of RNAi reduces overall fitness, so females are unable to devote resources towards producing eggs. An alternative explanation is that because treated flies are less active, the first mating is delayed compared to the control, resulting in fewer eggs at the end of the test period. The survival rates of the offspring of treated adults as measured by egg hatch rate were unaffected in both species (FIG. 5b). In our assay, the food source was coated with wild type yeast to encourage oviposition, which may have interfered with passage of transgenic yeast from the parents to the offspring.

Ingestion of Yeast Biopesticide Decreases Larval Survivorship

Ingestion of yeast expressing dsRNA targeting blw and γTub23C during the larval stages decreased survival to adulthood in D. suzukii, but not in D. melanogaster (FIG. 5c). Adults of all tested species fed on yeast expressing dsRNA did not have increased mortality in this study. Larvae consume a greater amount of food per day compared to adults. Since the larvae were fed in a no-choice assay, and the adults were fed with a choice between live yeast and artificial diet, we reason that larvae likely received higher dosage of yeast. Differences in dosage could explain why the yeast feeding treatment induces mortality in larvae, but not in adults. Alternatively, we speculate larval stages could be more susceptible to RNAi than adults due to differences in the absorptive properties of the midgut or robustness of the RNAi pathway.

Discussion

Here we show that genetically modified yeast can be used to deliver dsRNA to an insect pest, causing decreased fitness through RNAi. Ingestion of this modified yeast by adult D. suzukii results in decreased locomotor activity and reduced egg laying. Larvae exhibit reduced survival to adulthood when fed on yeast expressing dsRNA, and adults and larvae have altered target gene expression following yeast feeding treatment. We find the effects of the yeast feeding treatment on fitness are species-specific, even when testing closely related species. Since species with divergent target gene sequences, such as D. simulans, were unaffected by the yeast feeding treatment, we find it unlikely that sequence-independent effects were responsible for the observed decreases in fitness. Changes in target gene expression following yeast feeding treatment were observed in D. suzukii but not in D. melanogaster (FIG. 4a), D. biarmipies, D. melanogaster, and D. simulans exhibited no changes in locomotor activity (FIG. 3b). Together, these results indicate sequence-dependent target gene knockdown via RNAi was the primary cause of decreased fitness observed in D. suzukii.

This yeast biopesticide could be improved as a delivery vehicle by additional modifications to the yeast genome. S. cerevisiae lacks a functional RNAi mechanism[37], which might make it a suitable dsRNA delivery vehicle if the absence of RNAi machinery promotes stability of dsRNA. On the other hand, the delivery of dsRNA pre-processed by DICER or other components of the RNAi machinery might induce a stronger RNAi response in insect cells compared to long, unprocessed dsRNA. Thus, the insertion of key dsRNA processing genes into the yeast genome should improve efficacy of this yeast biopesticide. Another improvement to the current design is to create modifications such that dsRNA is excreted from the yeast cells in membrane-bound vesicles. In the current design, dsRNA is expressed from circular DNA plasmids and remains within the cell. We hypothesize that dsRNA is absorbed into insect cells only when yeast cells are lysed within the insect midgut. It has been previously demonstrated that lipid encapsulated siRNA is more stable and more readily absorbed than naked siRNA[38]. Therefore, continuous excretion of dsRNA in membrane bound-vesicles from intact yeast should increase the dosage and absorption of dsRNA into insect cells.

The biosafety of this yeast biopesticide could be increased by adding a built-in mechanism of containment. A common concern with genetically modified organisms is their containment and potential negative impact on the environment. Yeast can be carried from one location to another by Drosophila, so it seems likely that genetically modified yeast could be spread beyond the boundaries of agriculture. Our design can be improved simply by placing the dsRNA under a promoter that requires the presence of an artificial molecule in order to prevent expression of dsRNA in the yeast where it is not wanted. Recently, bacteria known as synthetic auxotrophs were engineered to only be viable in the presence of the synthetic molecule benzothiazole[39], which prevents genetically modified bacteria from escaping and increases biosafety. This technology could be applied to yeast biopesticides to prevent unwanted escapes.

We predict that this yeast biopesticide could be successfully implemented in the field to combat D. suzukii. The emergence of insecticide resistance and increasing popularity of organic food products may open the door to non-chemical means of pest control in both organic and conventional farming. A method for administering this yeast biopesticide in the field has already been presented, since yeast baited traps have previously been used in berry crops to lure D. suzukii[27]. Additionally, there is precedence for the agricultural use of genetically modified fungi, as the USDA has issued 26 permits for environmental release of genetically modified fungi since 1995[40]. A major limitation of the current design is that mortality is not induced in adults. However, we found this yeast biopesticide significantly decreases egg laying and therefore could decrease the population size of the next generation. This yeast biopesticide could be used in complement with chemical pesticides by targeting detoxification genes rather than critical genes. By altering expression of detoxification genes, D. suzukii could be made more susceptible to chemical pesticides. As different types of insecticide resistance emerge, the genes targeted by the yeast could easily and quickly be changed to compensate. Targeting multiple genes simultaneously may also increase toxicity of this biopesticide. Further screening is required to identify groups of target genes that will have additive effects when knocked down together.

Another characteristic of yeast that makes it an interesting candidate for a biopesticide is that unlike chemical pesticides, it can be easily grown with commonplace starting materials. Currently, live *S. cerevisiae*, commonly known as brewer's yeast, can be purchased in packets from any grocery store. The yeast in these packets is dry and does not require refrigeration. We envision that in the future, a yeast biopesticide could be similarly packaged and distributed to farmers in developing countries, where it could be cultured at the site of use.

A limitation of all RNAi-based technology is potential off-target effects. Only partial complementarity between the guide strand and the endogenous mRNA is required to prevent translation, so silencing of related transcripts in humans and other non-target species is a concern. In addition to sequence-dependent off-target effects, introduction of dsRNA into mammalian cells can have sequence-independent effects on the immune system [41]. For example, dsRNA can activate an innate immune response in mammals, resulting in increased levels of inflammatory cytokines such as tumor necrosis factor and interferons [42]. In this pathway, dsRNA binds and activates protein kinase R, which phosphorylates and deactivates eukaryotic initiation factor eIF2, thereby inhibiting translation in cells that contain dsRNA [43]. Since these effects on the immune system are not dependent on the sequence of the dsRNA, even careful selection of target sequences cannot mitigate these off-target effects. Pesticides containing dsRNA will need further testing to determine if they are safe for human consumption.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

TABLE 3

Primers for molecular cloning and Quantitative PCR

| Purpose | Primer Name | Species | C ° | Sequence |
|---|---|---|---|---|
| qPCR | CBP20 F | *D. suzukii* | 63.3 | AGGAGCAGATCCACGAGCTC |
| qPCR | CBP20 R | *D. suzukii* | 63.3 | ACTCCACGAAGCAGAAGCC |
| qPCR | Tubulin F | *D. suzukii* | 63.3 | AATGTTTACCTATCCAAGCATG |
| qPCR | Tubulin R | *D. suzukii* | 63.3 | TCGAGTGGCAGAGTATGAATC |
| qPCR | Bellwether F | *D. suzukii* | 63.3 | TCATCTCGATTACCGATGGAC |
| qPCR | Bellwether R | *D. suzukii* | 63.3 | AACTCCAGCTTCATGGAACC |
| qPCR | Actin F | *S. cerivisiae* | 63.3 | ATTATATGTTTAGAGGTTGCTGCTTTGG |
| qPCR | Actin R | *S. cerivisiae* | 63.3 | CAATTCGTTGTAGAAGGTATGATGCC |
| qPCR | Blw dsRNA F | dsRNA detection | 63.3 | AGGCTGTGGCCTACCGTCA |
| qPCR | Blw dsRNA R | dsRNA detection | 63.3 | AGGGAGCCACCTCCCATG |
| qPCR | Tub dsRNA F | dsRNA detection | 63.3 | ACGGACGGTCAGGTACTAGC |
| qPCR | Tub dsRNA R | dsRNA detection | 63.3 | TGCGAGTCTTATAAACAATGTGCT |
| qPCR | Ace dsRNA F | dsRNA detection | 63.3 | TGAACAACATTTTCGGCAAG |
| qPCR | Ace dsRNA R | dsRNA detection | 63.3 | TGGGCATACTCGTTGGTG |
| qPCR | Rpl19 dsRNA F | dsRNA detection | 63.3 | TACCGTGTGCGCAAGAAC |
| qPCR | RpL19 dsRNA R | dsRNA detection | 63.3 | TGTCGATCTTCTTGCTGTCG |
| qPCR | CBP20 F | *D. melanogaster* | 55 | GTCTGATTCGTGTGGACTGG |

TABLE 3-continued Primers for molecular cloning and Quantitative PCR

| Purpose | Primer Name | Species | C° | Sequence |
|---|---|---|---|---|
| qPCR | CBP20 R | D. melanogaster | 55 | CAACAGTTTGCCATAACCCC |
| qPCR | Bellwether F | D. melanogaster | 55 | TCATCTCGATTACCGACGGAC |
| qPCR | Bellwether R | D. melanogaster | 55 | AACTCCAGCTTCATGGAACC |
| qPCR | Tubulin F | D. melanogaster | 55 | TTTCCCAATCAGGACGAGATC |
| qPCR | Tubuiln R | D. melanogaster | 55 | TGTTGATCTGCGAAAAGCTG |
| cloning | Ace(XbaI)F | D. suzukii | | GTGT TCTAGA TGCCACGGGACAAATATCTC |
| cloning | Ace(HindIII)F | D. suzukii | | GTGT AAGCTT TGCCACGGGACAAATATCTC |
| cloning | Ace(BamHI)R | D. suzukii | | GTGT GGATCC GTAGTAGTGCACGGAGGCGC |
| cloning | Ace(EcoRI)R | D. suzukii | | GTGT GAATTC GTAGTAGTGCACGGAGGCGC |
| cloning | Blw(XbaI)F | D. suzukii | | GTGT TCTAGA ACGCCCTGATCATCTACGAC |
| cloning | Blw(HindIII)F | D. suzukii | | GTGT AAGCTT ACGCCCTGATCATCTACGAC |
| cloning | Blw(BamHI)R | D. suzukii | | GTGT GGATCC TGGAATGTAGGCGGACACATC |
| cloning | Blw(EcoRI)R | D. suzukii | | GTGT GAATTC TGGAATGTAGGCGGACACATC |
| cloning | Tub(XbaI)F | D. suzukii | | GTGTTCTAGAACGCTAAGTCGGAGGAC |
| cloning | Tub(HindIII)F | D. suzukii | | GTGTAAGCTTACGCTAAGTCGGAGGAC |
| cloning | Tub(BamHI)R | D. suzukii | | GTGT GGATCC ACAGTATTAACATACATGCG |
| cloning | Tub(EcoRI)R | D. suzukii | | GTGTGAATTCACAGTATTAACATACATGCG |
| cloning | Rpl19(XbaI)F | D. suzukii | | GTGT TCTAGA GGTCTGATCATCAAGAAGCCC |
| cloning | Rpl19(HindIII)F | D. suzukii | | GTGT AAGCTT GGTCTGATCATCAAGAAGCCC |
| cloning | Rpl19(BamHI)R | D. suzukii | | GTGT GGATCC AGGTGCCTGTCGATCTTCTTG |
| cloning | Rpl19(EcoRI)R | D. suzukii | | GTGT GAATTC AGGTGCCTGTCGATCTTCTTG |
| cloning | White intron F | D. melanogaster | | GTGTGGATCCGTGAGTTTCTATTCGCAG |
| cloning | White intron R | D. melanogaster | | GTGTGAATTCCTGAGTTTCAAAATTGGTA |
| cloning | Tub(T7)F | D. suzukii | | GAATAATACGACTCACTATAGGGAGAACGCTAAGTCGGAGGAC |
| cloning | Tub(T7)R | D. suzukii | | GAATAATACGACTCACTATAGGGAGAACAGTATTAACATACATGCG |
| cloning | vATPase(T7)F | D. suzukii | | GAATAATACGACTCACTATAGGGAGATGGAGCAGTACAAGGCC |
| cloning | vATPase(T7)R | D. suzukii | | GAATAATACGACTCACTATAGGGAGAAACAGGGCGTTACGAATC |

REFERENCES

1. Coy. M. R. et al. Gene silencing in adult *Aedes aegypti* mosquitoes through oral delivery of double-stranded RNA. *J Appl. Entomol.* 136, 741-748 (2012).
2. Jarosch, a. & Moritz, R. F. a. Systemic RNA-interference in the honeybee *Apis mellifera*: Tissue dependent uptake of fluorescent siRNA after intra-abdominal application observed by laser-scanning microscopy. *J Insect Physiol.* 57, 851-857 (2011).
3. Li, H. et al. Long dsRNA but not siRNA initiates RNAi in western corn rootworm larvae and adults. *J. Appl. Entomol.* 139, 432-445 (2015).

4. Zhang, J., Khan, S. A., Hasse, C. & Ruf, S. Full crop protection from an insect pest by expression of long double-stranded RNAs in plastids. *Science* (80-.). 347, (2015).
5. Copeland, J. M. et al. Extension of *Drosophila* Life Span by RNAi of the Mitochondrial Respiratory Chain. *Curr. Biol.* 19, 1591-1598 (2009).
6. Zhang, H., Li, H., Guan, R. & Miao, X. Lepidopteran insect species-specific, broad spectrum, and systemic RNA interference by spraying dsRNA on larvae. *Entomol. Exp. Appl.* n/a-n/a (2015). doi:10.1111/eea.12300 482
7. Chen. A., Zheng. W., Zheng, W. & Zhang, H. The effects of RNA interference targeting *Bactrocera dorsalis* ds-Bdrpl19 on the gene expression of rpl19 in non-target insects. *Ecotoxicology* 24, 595-603 (2015).
8. Obbard, D. J., Gordon, K. H. J., Buck, A. H. & Jiggins, F. M. The evolution of RNAi as a defence against viruses and transposable elements. *Philos. Trans. R. Soc. Lond. B. Biol. Sci.* 364, 99-115 (2009).
9. Kim, D. H. & Rossi, J. J. RNAi mechanisms and applications. 44, 613-616 (2009).
10. Zotti, M. J. & Smagghe, G. RNAi Technology for Insect Management and Protection of Beneficial Insects from Diseases: Lessons, Challenges and Risk Assessments. *Neotrop. Entomol.* (2015). doi: 10.1007/s13744-015-0291-8
11. Burand, J. P. & Hunter, W. B. RNAi: Future in insect management. *J. Invertebr. Pathol.* 112, (2013).
12. San Miguel, K. & Scott, J. G. The next generation of insecticides: dsRNA is stable as a foliar-applied insecticide. *Pest Manag. Sci.* n/a-n/a (2015). doi: 10.1002/ps.4056
13. Li, H., Guan, R., Guo, H. & Miao, X. New insights into an RNAi approach for plant defence against piercing-sucking and stem-borer insect pests. *Plant. Cell Environ.* n/a-n/a (2015). doi:10.1111/pce.12546
14. Tian, H. et al. Developmental control of a lepidopteran pest *Spodoptera exigua* by ingestion of bacteria expressing dsRNA of a non-midgut gene. *PLoS One* 4, (2009).
15. Taracena, M. L. et al. Genetically Modifying the Insect Gut Microbiota to Control Chagas Disease Vectors through Systemic RNAi. *PLoS Negl. Trop. Dis.* 9, e0003358 (2015).
16. Starmer, W. T. A Comparison of *Drosophila* Habitats According to the Physiological Attributes of the Associated Yeast Communities. *Soc. Study Evol.* 35, 38-52 (2013).
17. Becher. P. G. et al. Yeast, not vinegar volatiles mediate *Drosophila melanogaster* attraction, oviposition and development. *Funct. Ecol.* 26, 822-828 (2012).
18. Scheidler. N. H., Liu, C., Hamby, K. A., Zalom, F. G. & Syed, Z. Volatile codes: Evolution of olfactory signals and reception in. *Sci. Rep.* in press
19. Palanca, L., Gaskett, A. C., Giinther, C. S., Newcomb, R, D. & Goddard, M. R. Quantifying Variation in the Ability of Yeasts to Attract *Drosophila melanogaster*. *PLoS One* 8, 1-10 (2013).
20. Starmer, W. T., Peris, F. & Fontdevila, A. The transmission of yeasts by *Drosophila buzzatii* during courtship and mating. *Anim. Behav.* 36, 1691-1695 (1988).
21. Coluccio, A. E., Rodriguez, R. K., Kernan, M. J. & Neiman, A. M. The yeast spore wall enables spores to survive passage through the digestive tract of *Drosophila*. *PLoS One* 3, 516 (2008).
22. Lee, J. C. et al. The susceptibility of small vinegars and cherries to the spotted-wing *drosophila, Drosophila suzukii*. *Pest Manag. Sci.* 67, 1358-1367 (2011).
23. Asplen, M. K., Anfora, G. & Biondi, A. Invasion biology of spotted wing *Drosophila* (*Drosophila suzukii*): a global perspective and future priorities. *J Pest SC* (2015). doi: 10.1007/s10745-006-9094-1
24. Walsh, D. B. et al. *Drosophila suzukii* (Diptera: Drosophilidae): Invasive Pest of Ripening Soft Vinegar Expanding its Geographic Range and Damage Potential. *J. Integr. Pest Manag.* 2, 1-7 (2011).
25. Bolda, M. P., Goodhue, R. E. & Zalom, F. G. Spotted Wing *Drosophila*: Potential Economic Impact of a Newly Established Pest. *Agric. Resour Econ. Updat. Univ. California. Giannini Found.* 13, 5-8 (2010).
26. Chiu, J. C. et al. Genome of *Drosophila suzukii*, the Spotted Wing *Drosophila*. *G3-Genes Genomes Genet.* 3, 2257-2271 (2013).
27. Iglesias, L. E., Nyoike, T. W. & Liburd. O. E. Effect of Trap Design, Bait Type, and Age on Captures of *Drosophila suzukii* (Diptera: Drosophilidae) in Berry Crops. *Hortic. Entomol.* 1508-1518 (2014).
28. Hamby, K. a., Hernández, A., Boundy-Mills, K. & Zalom, F. G. Associations of yeasts with spotted-wing *Drosophila* (*Drosophila suzukii*, Diptera: Drosophilidae) in cherries and raspberries. *Appl. Environ. Microbiol.* 78, 4869-4873 (2012).
29. Mao, J. & Zeng, F. Feeding-Based RNA Interference of a Gap Gene Is Lethal to the Pea Aphid, *Acyrthosiphon pisum*. *PLoS One* 7, 1-7 (2012).
30. Walshe, D. P., Lehane, S. M., Lehane, M. J. & Haines, L. R. Prolonged gene knockdown in the tsetse fly *Glossina* by feeding double stranded RNA. *Insect Mol. Biol.* 18, 11-19 (2009).
31. Wuriyanghan. H., Rosa, C. & Falk, B. W. Oral delivery of double-stranded RNAs and siRNAs induces RNAi effects in the potato/tomato psyllid. *Batericerca cockerelli*. *PLoS One* 6, (2011).
32. Baum, J. a et al. Control of coleopteran insect pests through RNA interference. *Nat. Biotechnol.* 25, 1322-1326 (2007).
33. Jackson, A. L. & Linsley, P. S. Noise amidst the silence: Off-target effects of siRNAs?*Trends Genet.* 20, 521-524 (2004).
34. Altschul, S., Gish, W. & Miller, W. Basic Local Alignment Search Tool. *J Mol Biol.* 215, 403-410 (1990).
35. Roignant, J.-Y. et al. Absence of transitive and systemic pathways allows cell-specific and isoform-specific RNAi in *Drosophila*. *RNA* 9, 299-308 (2003).
36. Li. X., Zhang, M. & Zhang, H. RNA interference of four genes in adult *Bactrocera dorsalis* by feeding their dsRNAs. *PLoS One* 6, (2011).
37. Harrison, B. R., Yazgan, O. & Krebs, J. E. Life without RNAi: noncoding RNAs and their functions in *Saccharomyces cerevisiae*. *Biochem. Cell Biol.* 87, 767-779 (2009).
38. Wang. J., Lu, Z., Wientjes, M. G. & Au, J. L.-S. Delivery of siRNA therapeutics: barriers and carriers. *AAPS J.* 12, 492-503 (2010).
39. Lopez, G. & Anderson, J. C. Synthetic Auxotrophs with Ligand-Dependent Essential Genes for a BL21(DE3) Biosafety Strain. *ACS Synth. Biol.* 21, 150615074302001 (2015).
40. Hokanson. K. E., Dawson, W. O., Handler, a. M., Schetelig, M. F. & St. Leger, R. J. Not all GMOs are crop plants: non-plant GMO applications in agriculture. *Transgenic Res.* 1-12 (2013). doi: 10.1007/s11248-013-9769-5

41. Svoboda, P. Off-targeting and other non-specific effects of RNAi experiments in mammalian cells. *Curr. Opin. Mol. Ther.* 9, 248-257 (2007).
42. Robbins, M., Judge, A. & MacLachlan, I. siRNA and innate immunity. *Oligonucleotides* 19, 89-102 (2009).
43. Lemaire, P. a, Anderson, E., Larv, J. & Cole, J. L. NIH Public Access. *Cell* 381, 351-360 (2009).
44. Chintapalli, V. R., Wang, J. & Dow, J. a T. Using FlyAtlas to identify better *Drosophila melanogaster* models of human disease. *Nat. Genet.* 39, 715-720 (2007).
45. Larkin, M. a. et al. Clustal W and Clustal X version 2.0. *Bioinformatics* 23, 2947-2948 (2007).
46. Boutros, M. et al. Genome-wide RNAi analysis of growth and viability in *Drosophila* cells. *Science* 303, 832-835 (2004).
47. Chiu. J. C., Low, K. H., Pike, D. H., Yildirim, E. & Edery, I. Assaying locomotor activity to study circadian rhythms and sleep parameters in *Drosophila*. *J. Vis. Exp.* 1-8 (2010). doi:10.3791/2157

SEQUENCE LISTING (1193 sequences)

SEQ ID NO: 1 - DNA, 215 bp, Drosophila suzukii
ggtctgatcatcaagaagcccgtcgtggtccactcccgctaccgtgtgcgcaagaacaccgaggcgcgccgcaagggccgccactgcggattcggaaagcgcaagggtacggcaaacgcccgcatgcccaccaagctggtgtggatgcagcgccagcgcgtcctgcgccgcctgctgaagaagtaccgcgacagcaagaagatcgacaggcacct

SEQ ID NO: 2 - DNA, 221 bp, Drosophila suzukii
tgccacgggacaaatatctcgaaattatgaacaacattttcggcaaggcaacgcaggcggaacgcgaggccattattttccagtacaccagctgggagggcaatccgggataccagaaccaacagcaaatcggacgtgcggtgggcgatcacttcttcacctgccccaccaacgagtatgcccaggctctggcggagcgaggcgcctccgtgcactactac

SEQ ID NO: 3 - DNA, 230 bp, Drosophila suzukii
acgccctgatcatctacgacgatttgtccaagcaggctgtggcctaccgtcagatgtccctgctgctgcgtcgtcccccaggtcgtgaggcctaccccggcgatgtgttctacctgcattcgcgtctgcttgagcgtgccgccaagatgtcccctgccatgggaggtggctccctgactgccctgcccgtgatcgagacccaggctggtgatgtgtccgcctacattcca

SEQ ID NO: 4 - DNA, 183 bp, Drosophila suzukii
acgctaagtcggaggacggacggtcaggtactagcggcggtgtctagtttgctcttgccatcaacaatgcgtgccatgccttttctcgaatgtattttacaatttctgaagacgtcgggattggaaatcccaaagtattaataagcacattgtttataagactcgcatgtatgttaatactgt

SEQ ID NO: 5 - DNA, 382 bp, Drosophila suzukii
accagcagcagtgagcacacaagcgacctgtccgtgggtccatgttgtggcttcgagagcgacagcaatccctcctcctcaaccaccttcaatgccgcaccgaggaacatcggtgttgtggtgaggtcccccccgaaggcaaaaccctcgtcgccagtcaatgatttattgccccgcaggggtcggcgtccaaggaatgcgccgatataccatccccccaaacgacaacgacgatcgctggttagaagggagccgttgaagcgaaaagttatgacagaacaagttaacgcagagaaaagaaagtctgatcaaaatgatatttatccgccggaaccgaaggtggagaacatggccccatcctgcgatgaggccatcgacagca

SEQ ID NO: 6 - DNA, 608 bp, Drosophila suzukii
atgaggccatcgacagcacatccgatgcaccaaaggaattgccatcgaatgtggtccaagaggagtgtaatccaattaattcaaacaaagtttgtggtgatataaaccaggttgaaaaggagaaggaaatcacatcgaatggtttgatagagagttccaaccaggtgcgggctatcgaagaggatacagcccccaatggcttggttgaggaaaaggttcaagtccaagtagaactacctaaagctgatctaactgtcgtcagacatccttgtactgatgaaaatgacgaaattactggaacctaccgggagttactggaacagtttgaagccaccaccgcaccccaagaatatgcttcagatgatctccccattaaagaggaaatccaatccatattgaatgtcatcaaagctgaagctgatctagtgcagtccggggaactgacctcatccacggaacctagtgaattgcaaccgcaaattgttgatcagctcgtaactgtggagcagcaagcattagctatggaacagcaggaatccatggagcaaccggtgaaatctgtagaccaacctgactcagtggagcaaccggagatcatagtgagcata

SEQ ID NO: 7 - DNA, 331 bp, Drosophila suzukii
gtgcccacattgatgagtttctcactcccgccgattatgctccaatgacggagcaagagacgtccgtttcatcgccgcccaatcctttcgagcagagtccacgtgccgaaccggaggccaaacccaacgcctccgatgatcccttcgataacagcaacttcagcagcgaactgattggcttccagaacgatattccctgctttgagaatattgaaaccactacagaacagggacagaacctgcatttggagcttacacagttcctaagggatcttcagccggcactgccaaatcagcagcccggggagcaatgcaccaagacccaagttga

SEQ ID NO: 8 - DNA, 222 bp, Drosophila suzukii
gcacttccggccacagccacggccacgagcagtgcgaggagcaggcggcactgcaagctccgccaacggtgctcactccgccctcgaccatcgtctcggctccgtcgccgcagcccatgatgtactcgcagcacataaccatgccgtcaccggaacaatccgagccagattccacgaccacgttgagacagtaccgcaaacgtggcgtgatcgttgggccac

SEQ ID NO: 9 - DNA, 361 bp, Drosophila suzukii
tagcagttatggccatcgagaaataaaaggaacgaaaatgtattttttctctggcatcaatgggtatattggcctctacttcttgtcgccgcagcatttccccttggcgtcaccgcccgcggtgtcgccacccttcttgcaacatcccccggagggggcggcatttgcgggattgcatctacattgtccgggattttggcacttgcagctctcgccgcacttttccggggtgcatttgcattctttaccgcaaccgacacaaggcatttttgtgaaaattttccttcgtaaactttggttctcctaatttaaatccaaatagtacactgaatttttacggactggtatttggggtggcact

SEQ ID NO: 10 - DNA, 240 bp, Drosophila suzukii
gccgattaacattgtttggctgcgctcgggcaagaacacactgaatccatcaaccaattataagatctccgttaagcaagaggccaccccggatggagtatccgccgaactgcaaatccgcacggtggatgccaccgatagtggtccctacttctgccgggccagcaatctctatggaaacgatcagcagctagttcaactgcaggtccaggagcctcctttgccacccagtgtcctgga

SEQ ID NO: 11 - DNA, 207 bp, Drosophila suzukii
agaacctcaagccggcgactcgttacgcttttcgggtgattgccgagggttcggcgggtcgaagtgcacccagccaggagctgatcgttcgtacggagccgcagcgacctgcgggacctccactaagtctctcggccagacccttgtcctccacagagctgctcatcagctgggtggctccgttgccggaactgcgacatggtgaca

SEQ ID NO: 12 - DNA, 243 bp, Drosophila suzukii
gcactcgagtgggcgagggtaaaagctctcgggtgtcctcacagattacaacaaatcgtgtgcctgccaggatcatatccttcggcggttccgtggtcagaccctggcggtccaccgtaactcttccctgcacagcggtgggtaagcccaagagggagtggtttaaatcggacgtggccctgcgacaaggtggcatgcacaactctcagttactggacagcggagatctgatcatctccagcc

SEQ ID NO: 13 - DNA, 263 bp, Drosophila suzukii
acctggccatcctgcctccactgcccttttggcccctaactcgacctcgcttttggtccggttacactcttggccggacaatggatgtcctctgctgtactttgtgctgcagtacagggcagtgaccgaggatccggacgctgaatgggtgctggtatctaatgccctgaagcctcagcgccgcatagtggtcaacaatttgacaccatcgaccctttaccaacttcgcatggaggcacataacgtggctggaatctcgcagg

SEQ ID NO: 14 - DNA, 343 bp, Drosophila suzukii
tttgtgaccttgaccaaggacggggatccaccaccaccggaaatcgtgcatcgtggccatcgcggtcaaaccacagtgattttcgccaatatgaacctgctcatccccagcattgcggcggtctcgggaatgttctgcaccatcatcatggtcatcgtgtgctacagacacagtaagcatagccatacctttgtgattaactgcattgatccactaattgactcagtgcttaaaaatgcacaaccgcacgcagaacaagccaatcacattcaaaaggaatcattggagaatagagccaactcagaggctgcccagcgggaacgctattatgccaccattcaca

SEQ ID NO: 15 - DNA, 225 bp, Drosophila suzukii
agttcgatttccacacctactgcatgcgcaaaatgacactccgcgcctacgttggccttctgcggctagaggacgtactgcgccagcatcccttctacttcaaggcggctaagtgcgccatagaggtgtacatccgtctctacgacaagccgctcaagtcggaggcgaccattgaggagatcgacattgagaacctgcccccttcggaactgaagaagctgcgca

SEQ ID NO: 16 - DNA, 213 bp, Drosophila suzukii
gctactgcatagccaacggcctggagctggccctcatgtgtgacctgcgcgtcatggaagagtccgccgtactgggattctttaatcgccgatttggcgtgccaatgctcgatgctggcactattcgcctgccggccatgattggcttgtcccgtgctctagatctgatactcacaggacgtccggtgggctctcaggaggcccacgacattg

SEQ ID NO: 17 - DNA, 234 bp, Drosophila suzukii
ccagcaacagcgtggacaacggcggcatccggatgcagaatgcgacgctgaacgaacggaatccccagaacccctctgcaggaacagcgggagtgggaggcgtaaccacggcagcgggatcggggaatggcatctcgtcctccaccagttcgccgcatcatatgacccagttggacgtaaaggacaccaagatcttcagctcgaaggccgatctgcagctgcacacgcagatcc

SEQ ID NO: 18 - DNA, 348 bp, Drosophila suzukii
atttcgagcggatgaagggcgccacactgctctccgagggcatcgacgagatggtcggtattgtctatcgacccaagacgcaggaaacccgccagacctacgaggttctgctcagttttattcaggaagctttgggcgaccagcccagggacatcctgtgcggtgccgccgacgagatcctggctgtgctgaagaacgatcgccttaaggatcgagagcgaaagagggacgtggacagtttgctgggcgcagtcaccgaagagcgctttgccctgttggttaacctgggtaagaagatcacagacttcggcagtgatgccgtgaatgcattgactgctgctcccaaca

SEQ ID NO: 19 - DNA, 213 bp, Drosophila suzukii
acatgtatggcgagattcgtgatgatgatgcccaggacgagggcgaagaggcgcgcattgatcacaccctgcatgcggagaatgtgagttatacaagtaaaattgggaatcctctttataattcatatttcgttcccctttcacagctggccaacgaggaagccgccaataatgttaaaaaagagcgctctttgcatcctttggacatagatg

SEQ ID NO: 20 - DNA, 561 bp, Drosophila suzukii
tcctgtactgcaccatgctggcgtcagctcaaactgacagcgagagacaaagaattcgcgagaaaatgcgcgggaattccgcgctagccaagattctccggcagttggacacgggaaaggcagaggagcaggacgagggcgaatctcgtggcagtaagcgtggcaaaggggatgcagaggatggaggagcggcagctgcaggtcaggtggccggtgtgcggcaactacttgaattggacgagatggcattcactcagggatcccactttatggccaacaaacgctgtcaactgcccgatggttcctaccggaaacagcgcaagggctacgaagaggtgcacgtgcctgccctgaaaccagtaccgttcgatgacaacgaggagcttcagccggtggacaagctcccgaaatacgtgcagcccgtgttcgagggttttaagaccctcaatcgcatacaaagtcgtctgtacaaggccgcgttggacagtgacgagaatatgctgctgtgtgcccccactggagcgggtaaaaccaatgtggccctgctaaccatgatgcggg

SEQ ID NO: 21 - DNA, 324 bp, Drosophila suzukii
gggacatgtgcctggagcaagatacccttggtagcttcttaagggaaggatcagccagcatggaggtgcttcgcactgaagcagagcaagtgaagaacacagagctaaaggagctgctaccttatggatttgcaatccatcatgcaggaatgacccgtgtcgatcgaactctggtggaggatcttttcgcagatcggcacatccaggtgctagtttccaccgccacgttggcttggggtgtgaatcttccagctcatacggttatcatcaagggaacacaggtctacaatccggaaaaaggtcgctgggtggagctgagtgctt

SEQ ID NO: 22 - DNA, 516 bp, Drosophila suzukii
ccaagggtgagggtattctcattaccaatcacagtgaactgcagttctatctctccctgctcaaccagcaattgcccattgagtcgcaattcatctccaagctccctgacatgctgaatgctgagattgtgctggggacggtccaacatctacaggacgcagtgaactggttgggctatacttacctgtacatcaggatgctgaggaaccccactttgtatggcgtatcccacgatgccataaaggcggatcccttattggagcagcatcgggcggatctcttgcataccgccgcctgctgtctagagaggagtggtcttgttaaatacgatagaaagacgggacacttccaggtgacggatctaggacgcattgcctcccactactacctcacccacgaaaccatgttgacctacaaccagctcctgaagcaaactctcagtgagatcgagctgtttcgtgttttctccttgtcttcggagttccgacacatttcagtccgagaagaggaaaagt

SEQ ID NO: 23 - DNA, 360 bp, Drosophila suzukii
cggatttccaatgggatgagaaggtgcatggagcgtctgaaggtttctgggtgttgatcgaagatgtggactccgaactcattctccatcacgaattcttcttgttaaagcagaagtattcccaggatgagcatcagctgaagttctttgtgcccgtttttgaacccttgcctccgcaatacttcctccgaattgtctcggatcgctggataggagcagagacccaactgcccgtttcattccgacacttgattttgccggagaagaatatgccacccacggagctgctggatctgcaaccacttcccattagtgcactgcggcagcccaagtttgaatcgttttattcgcaacgcttcc

SEQ ID NO: 24 - DNA, 255 bp, Drosophila suzukii
attcgcaacgcttcccgcagttcaatccgatccagactcaggtcttcaacgcggtttacaacagtgatgaaaacgtctttgttggagctccaactggatccggaaagatgacaattgctgagtttgccattatgcggttgttcaccactcaatcggatgccagatgtgtctatttggtttcgcaagaggctctggcagatcttgtctttgcggattggcatagtaagtttggtgcactggacataaaagtggtta

SEQ ID NO: 25 - DNA, 213 bp, Drosophila suzukii
agttggtggagaatacgctaagcgatttggagcagtcaaagtgcatcagtgtagaggacgatatggacacccttccacttaatctgggcatgattgcggcatactattacattaactacacaacgatcgaactcttcagtttgtcccttaacagcaaaacgaaagtacgtggcctgctggagattatttcatctgcagctgagtacgaggatg

SEQ ID NO: 26 - DNA, 262 bp, Drosophila suzukii
actacatgagcgattcctacttgggctgcgatcaagagtacaagttttcaattgaagtgggcgatttccagtcggaaagcgagagcgagtcagattagttatcttaaggaacatcagttgggcgtagtctcgcaaataaagatcaaccattttacaatttaatcccaataattgtggcaataatttttaatcgattcttaaattacaagcgagtatcacaaatttgtaaatgcaatgctggggaaaattattttattatttt

SEQ ID NO: 27 - DNA, 239 bp, Drosophila suzukii
ttatgatgctgtgggatggtctcagcacaaactccaactcgacggtgattgtaatgggcgccacaaacagacctcaggacctggacaaggccattgtccgccggatgccagctcagttccacattggccttcctaccgagactcagcgaaacgacatccttaaactgatattgcagtcggaggaaataaaccaagatgtcgacctgaatcggttggccaagcttacaaatggcttctcc

SEQ ID NO: 28 - DNA, 234 bp, Drosophila suzukii
tggaatacggaaccaccatcaagtcggtgtcggagaacatcattgtcaatcccggcgaggacgcaatgctgtcctgcagcgtggagggcaaaccgctgagcgacgagcatgtgaagtgggagcgggtgggctacgacatgaccgtgaagacatcgacgacctttgcgaacggcacctcctacctgcacatcaaggatgcgcagcgcgcggatgtgggcaacttccggtgcgtgg

SEQ ID NO: 29 - DNA, 321 bp, Drosophila suzukii
acctccgctgggtggcctgcgttctggccagtctgtggatatccgtgagccatgctcagttgccaggagcaggcttccaaggacaacgggggcaggtgcctcctctgcaaccactgcaacagccagccaatcccttccagcgccgccagcccaatcccgtccagggtcaaggactatttccgggtcagcgaaataccttgaatcccctggctcctccgctaactggagctgccctccagaatccctacacgcgctataaccagtaccagcagcagaactacgtgcccatcacagcctataacaacgaactcaatctggatg

SEQ ID NO: 30 - DNA, 258 bp, Drosophila suzukii
ccactgcccaggcacagggttatgttaaaaacctaggatatggggaaggcgtcgaggcacaggtgattcaaggctcctactcgtacacatcaccggagggcactcccataacagtgcgttatattgccgacgagaacggattccgggcggagggcacaggaattccagcctccccgcaatatttctcgggggcccaaccctatcaacagggtctgctaaatccaaatttgaatccctatcagacgcccttccgccagc

SEQ ID NO: 31 - DNA, 435 bp, Drosophila suzukii
tgtgggcagaacggcaagggttggagctggcggcggactgccacctggccaagattaaccagtgtgcgcagtttttgcaagcacccaaatcctccgtagaggagattcaacagttggcctgttcctgcttccgtttgaactccctgcagatggctgcgttgctccagcaggagaagctgccgcgcaacctggtagatacggccatacggatggccgagtccgtggccgacgagctgacccgtgccgatggccgagaagtgcggctggaagagtcacctgagctgcacttggcattgctgcttcccgacgacggattcagctgcgatgttgtgcgaggcatacctacaggtctggtggacttcctgaatcctcttcagcagcagggcatgtgtcgtctggcggcccagcccacctcgattggcctttggacggtct

SEQ ID NO: 32 - DNA, 315 bp, Drosophila suzukii
gggcctcctcaccgccggtaaggcgtttaagtgcctcctgtctgcaggaggaactgtgtgccctgggccatcagttgcacatcgatccgaggtatcgggacactagacccattgcccgatctgccagcagtttgtatttgggtaacgatcagggtgcctactatcacccaccgccgatggccccctctgttacccactttagtcccatgagaccgctgagaagaactccaccgccttcgatctttatcgaagagtaccaggatgagccgcccaaggactcgcaggaatcgtttgggaactttgccgcctacagtg

SEQ ID NO: 33 - DNA, 326 bp, Drosophila suzukii
tgttgcccctgggtcagggcaaggtccgcgagatggccgactacttcaatgccaacaagaacttcccgcccagcattaataagtcccgttccacatcggccctggatgatcccggcagcaagccatgtgccaaactctctcaggcggagcagggccacatcctcaagcagctgaaggagtggagtctgtatggcagtgcgggcaaggattacgataaagcgggaaagcccggcgataaaacaggctgcgattgcccctgctgcggtcattgtcgcggaaagacccccgagcaagagcaacatcaagggaaacagcagcaacagcag

SEQ ID NO: 34 - DNA, 259 bp, Drosophila suzukii
gggaaagggaggagcgtgaaaaggaccttgaaatgcgacgcgaacacattcgccaatggcgggagcagcagatctcagagctctcgcagatcatctcccgatcccccatgcaggaggagcaactgaaaaccttgattctggagcgagatttcgagcgaagagcgcaggagttgcaagagcaggaggagcaggatcaggagcagcaatacgacaaagagaacgtgcaagagctgttccgactggctggcggcggtcaggt

SEQ ID NO: 35 - DNA, 327 bp, Drosophila suzukii
gtcaggtcagtgccatacagacacccatcacgagttaccggcagacggagatcaagctggcggagattacggacagcagcagtccggtggaatcagtgccaacaccacagcctccaccagcgactagccaacccacgagcaacaacactcagcagccgaagagcatactcaagcataatcggtattccgagggaggggcgggtcccactgcaccctcttcgccgtcaaaatcgcagaaatcagccagtttcgcggacgagcggcatctgcacacagaacatccgatatcgaatttggcaaaagagctcaatcagctcacaatgcttg

SEQ ID NO: 36 - DNA, 245 bp, Drosophila suzukii
tccaccaccaccgccaccagagaggaacagttcttacttgatcatgtctcagcaaaaactgcggggcagcactggaaactcgtcaatgggtctactcaaaacagcgactagtaatcaggcagcagctgccgtggagattaagaaggcttctctcctgaacacccaatccaataataacaacaacctgagtggcagcttgaacaacaacaccatgcagggatcaccgctcagcgccatggagctaa

SEQ ID NO: 37 - DNA, 375 bp, Drosophila suzukii
aaaacattcccctgcccacaacggctgccgccagttccagttccagctcgagttgcagctgcagctctagctcttcggcctccgcatcatcgtcatcctcttccagtggagcctgcaccaccattggcggctgccagcaggatcccatagctgccaagctgacctcatgcttgtgcacacgtctacccacgccgtcagtggctccgccggtggcctccctggtctcacccagtgctcctctaaccagatccggctccacgagctcatccggcaagtgccaggaatcgagttgcagtggggcgagtgccggatacgcagcacgttcgactgcctcgggcgcaggcgtcaccttctcgggcaattcgatgctgcaca

SEQ ID NO: 38 - DNA, 244 bp, Drosophila suzukii
ctccaaggaggtgttcacccacaagatcgatctatccggggccggcgtggtgaccagcagccgtagctccagcagtggaacagcctcaagtggatcggcaagtggcgaggaggcaccgcgcaagggcggatcgggagccgtaatcgagtcgatgaagaaccacggcaagggcatctattcgggtaccttctcgggcactctgaatccggcgctgcaggatcgctatggacgacccaaacgcgac

SEQ ID NO: 39 - DNA, 274 bp, Drosophila suzukii
actaccgctaacaacgttgagctaatggaggccattaagaagttggatgccgatttggtggccctttttgccacagctgccgccgccgagccgctaaagatgaagcaacagcagcaggtcctgtggtccgaatcggagtcggagcagatcgcccaggattcggaggatgagctggtcatcacgccggagttgttccgcagctgcaatgccctgcagctccatttggaggcgttgactctgcagccggagggtactcaacgcatggaactggttc

SEQ ID NO: 40 - DNA, 267 bp, Drosophila suzukii
agggaaagctaccagtgatttccatcgacggctgggcccccattgtcgctgctgatacccagacgcctctgggggaactaaaggtgctcctggccatcggaagtgagtcgcagatagctcaacttaagcagcaacgcggctttgaccaggacaataaccaagtgccgactccaagtagcaccaccgatttgcttgacatgctccagaatgccatcgcagctccaacgccgagtattccaacaccagtgatgccgccgccaccggctc

SEQ ID NO: 41 - DNA, 298 bp, Drosophila suzukii
gtgaccttccaggccatcaattgcaatagtcagacgtacaagtcacacgagggattggtctatgccacgcccgtagtggctaggtccaccaagccccagtggatgagcaagtttcgggtggaagtgagccgcgattaccgcaacaatccccagaagctcttcatcttaaagctatggaagaaggcaattgttagccccaacggcatcactgaaccgtcaccccacgaggatgctattatagggatcgcagctccaacgccgagtattccaacaccagtgatgccgccgccaccggctc

SEQ ID NO: 42 - DNA, 293 bp, Drosophila suzukii
gtgaccttccaggccatcaattgcaatagtcagacgtacaagtcacacgagggattggtctatgccacgcccgtagtggctaggtccaccaagccccagtggatgagcaagtttcgggtggaagtgagccgcgattaccgcaacaatccccagaagctattcatcctaaagctatggaaaaaggcaattgttagccccaacggcatcactgaaccgtcaccccacgaggatgctattatagggttcgcggccctgaatctcaaccagaaacaaccgggcggaggctttcccag

SEQ ID NO: 43 - DNA, 242 bp, Drosophila suzukii
cggagctggaggagatctctcagagattgcgatctcgtttggtggacgtgacgggggaaacgctaaagttccccgagttcgatgtggacagtgcactggatagttggcagcaggatggcgatgacgatgacttggcggaggactttgaacgggctctgcgcacgcccacgccccctgactcaccgacgccctccaccagcagcgccgcacaaaatctcaaaaattcaaacggccgggaatag

SEQ ID NO: 44 - DNA, 265 bp, Drosophila suzukii
acaagcgcagcgtttcgctagagaacaacgcccctttggcgctgcgtggcacgcccagtttgggccaatcctcgctgggatcgccgctgctgcagtttggccagggtccgaatccgacaccaggacactcgcaggccttccacacgggcaccctgaagtcccgccaggagcagcggcggctgagccagaaattcgggagtcacagcaatctggacgacgagggcgtgggcattggagtgggcgggggcatgggcgtgggcatggg

SEQ ID NO: 45 - DNA, 300 bp, Drosophila suzukii
agaagacacgaaagtacaccacatcaaccgcatccatggccgcatctccgactgctccggctgttccggctgccagccaggagctgccgctgcccaagctggatgtcctggtgcagcgattgcagctggatcagggacaggctccgcagcaaacgctggacaccctgatcgaggagtcgaccacgtatgccgaggacatagccaagctgcggcagaaactggacgacttccggctgaacctggagctggagaagcgccagtggtgcgccgagaaggacaaggtgctgggctaccagaagc

SEQ ID NO: 46 - DNA, 204 bp, Drosophila suzukii
gtggtcagcatccgcactttcatcaccacaccacgcccgcctactacacggatctccagctgaggatccacacgccgaatgcatcggatgtgggggcgctgaacgagaactatcgcagtgtttacagtactcccagtacccagctggtggagcagcgttcgtttcccaaaagctccacggccaccaaggatccaccgctgccca

SEQ ID NO: 47 - DNA, 545 bp, Drosophila suzukii
agagcaggctagtccaccaacaccaccacccagtagcgtagccaatcccagcggatccggatccggtcgcaccagccggcacaagcagcgattccacagtcgatcccggcgagcgcagcaaccggagaagcaacatcaccagcaacttcttgtccaaggagcaaccaaggacttgccggcgggctgcagcagcagcagcgatgatgatgaggtttcgctgcgggcactgcactccacccgcaaggtcaccaacctgccaagtgccaaggccacgtcgctgccaccggaggagggaaatccggaggagattgccctgtcccggacctcctccaaccgactgagtctgcgattggccaggagtctggagccctcggtccgtaatatccccacatcggcctcccaggaagtccagaactacgatgctggagagccagtgaatacggagcgtctgtttgtggaacctcccaacataccattgtctgccatcaggaacaccctttacgatcatgatctggagatcgaagactgcgacagcaccacccagt

SEQ ID NO: 48 - DNA, 216 bp, Drosophila suzukii
cgcccaagtcgccaggtgctagtgggttcaactcggagccagtaccgtcagccagttcgggaaagatcccggcgagatctgcctcccagcccgaggacacaccgcccacccaaagacgccaacccctggtggccgtgggttcgggaatttccatgaagcagagcctcagcgaactgcacttcacgggcggagccattagtccgcccaaggctacgg

SEQ ID NO: 49 - DNA, 285 bp, Drosophila suzukii
gcagcgagtcaaccaactcaatttcggaaccctaccgtcagtttataccagccgtacgtcatccggaggttccagtgcgcaccatgaccgctgttttgcctgcaccacgacctttgcatgcgcctgtggccaggagtgtcacccagaagtttaatgaaaggaccaaaaccgatctggcggagatcaagaagattgccgagcaatcggaggtgcagcaacaacagccttcggtggacgagagccagaagatgtcggccataatgcggaggaagagcacggatgagg

SEQ ID NO: 50 - DNA, 200 bp, Drosophila suzukii
tcaagcagagcagctacgatagcagcaagagtgatggctgcccatcggctacggagagccagccgcatagcatcctgaagaaaaaggactcactatccacaccctcggatggcggttgccacaagcatgtgtccatttcgcaggctgtgatcttggctgcggctgaactggccgcccatgatggcatcaccttcgaggat

SEQ ID NO: 51 - DNA, 426 bp, Drosophila suzukii
cctttggcgaggcggatgagcatgagatacgacccatactgaagagctctcgcaagagcagccgtgaggagtttgacttaagtggtttggagagcgaggtcaacgattccctgtcctccatcctcaagacagactcgccctcgaagcgtcgatcgctgggttccgcatcacatgatctggaggagtcaaacacatctccgagcctgttgaagaggcgaacccgttcgctggagcgacgggatgtccagcctggaatggatttggcagccgcactggatgctattgccacctcgcaggtcgcacccagcacaccagttgattttgtgaccacaccagcgagtatttcggtggcggagcggattaagcgcatggaaatgctctccacgcccacttcccgtgaggcgggcggggccaacagcagctggg

SEQ ID NO: 52 - DNA, 210 bp, Drosophila suzukii
tatccatcggcacggacagtgagcacatcttcgagatgtccgccctggaggaggattcggccattcagtcgctgagcgatgagacagccgcttccgccaactctgcatctgctaactcaacatccaccgcaaccaacagcaccaccaccacaacaccaccgagtggtttgacgcggagcaacagcgtccgagccagggccaatatgttcc

SEQ ID NO: 53 - DNA, 246 bp, Drosophila suzukii
cgcaaccacagcccgtcaaccggcgtcacaccaccgagatcaccaccgtgaccatccgatctcccaatgtggatgatcggtttgccaagtatttcggggttaaagagagtttcaatagcaccaccaccctgctgaaaacgcaatcgctggcaccaacgaccaaccaagtagaggccaccaattcccatgtccgactaccgatcaccaccgtggtctccaagcggcgagagctgctcaagaggacgc

SEQ ID NO: 54 - DNA, 219 bp, Drosophila suzukii
cttgggaagataaaactcccggtgaccatcgatgggatgagactcctggacacaagggcagtgagactccaggagccactccgggactaggcacccgtatatgggacgctacaccggctcacgctatgaccccgggccacgagacacctggacacgagaagtccgctaggaggaatcgctgggatgaaaccccgaagactgagcgtgagactcccggac

SEQ ID NO: 55 - DNA, 273 bp, Drosophila suzukii
aacgtcgctctcgttgggacgaaactccatcgaatgccacgcccgctattacgcccacaaatgcaaatgccatgaccccgaacatgactccaagcatgacgccacatgctactccaggacatgctacgcccatgctgacgccaggaggcagcactcccattggagtcaaggctatggccatggccactccctcggcgggagctctggccgccatgacgcccgagcagctgcaggcatatcgctgggaaaaggagatcgacgagagaaacaggc

SEQ ID NO: 56 - DNA, 351 bp, Drosophila suzukii
tcgacgagagaaacaggccttacacagacgacgaattggaccaaatcttcccacctggttacaaaattttacccccaccagctggatacgttccactccgcactcccggcaggaagctgatggccacacccactccaatcgctggcactccagctggattctttatccaagtggaggataagaatgccaagttcatggacaatcaaccaaagggacagaatctcccgttcatgaaacctgaggatgcgcaatatttcgacaaactcttggtggacgtcaatgaagatgctttgtcgccggaggaactcaaggagcggaagattatgaagctgctgctgaccatcaagaacg

SEQ ID NO: 57 - DNA, 252 bp, Drosophila suzukii
ttttggtggtcatagaacctctgttgatcgatgaagatcactatgcccgcatagaaggtagggaaatcatttccaatctggccaaggctgctggcttggccaccatgatctcaaccatgagaccggatattgacaacatcgatgagtatgtgagaaacaccacagcgcgagcctttgccgtggtggcctcagcattgggcattccctcgctattgcccttcttaaaagccgtgtgcaagtcgaagaaatcct

SEQ ID NO: 58 - DNA, 252 bp, Drosophila suzukii
tggacgccgagtacgctaactactatacccgagaagtgatgttgatcctcatccgtgagttccagtctccggatgaggaaatgaagaagatcgtcttgaaggtggtgaaacaatgttgtgccaccgatggtgtggagccgcagtacataaaagaggagatcttgccgcacttcttcaaattcttttggaaccaccgcatggcgctggacagacgaaactaccgacagctggtagacaccaccgtggagattg

SEQ ID NO: 59 - DNA, 213 bp, Drosophila suzukii
tgggacgaattgcagatcgaggcccagaatatgtgtctgctcgcgagtggatgcgcatctgctttgagcttctggagttgctaaaggcccacaagaaggcaattaggagagccacggttaacacctttggttacatcgccaaggcaattggaccccacgacgtgctggctactctgctgaataatctaaaagtccaggagcgtcagaaccgcg

SEQ ID NO: 60 - DNA, 352 bp, Drosophila suzukii
gctgcgaggatgctttgacgcatctccttaattacgtgtggcccaatatctttgagacctccccccatcttgtgcaggccttcatggactccgtcgatggtttaagggtgtctctgggacccatcaagatcctgcagtacacgctacaaggacttttccatcccgctcgcaaagtgagggacgtctactggaagatctacaactcgctgtacatcggaggtcaggacgcactgattgccggctatccgcggatcaccaacgacccgaagaaccagtacgagcgatacgaactggattacacgctctaagttttttagctaatcggctagcagtaggattctctaagatacaa

SEQ ID NO: 61 - DNA, 219 bp, Drosophila suzukii
agtaccggaacatgttccaactggtaaacgtgaactcgctggagaacgtaatccgcggctacctaaagatggcagaggagcacacggaggccgctcaggcgcagtcctcagcggccgtggccgtcctggagctggatgacttggacaatattgccacgcccgagagcatcctgatgagcgccgtgtgcggcgaggacgcccaggaccgctccgaccgca

SEQ ID NO: 62 - DNA, 375 bp, Drosophila suzukii
ttcgtcagatctctcaggtctatgaaagcatccagtttcagcgtctgttgcagctggccagcttctgcaacatttttgagttagaaaagctactggtcgagtcggtgcgacataacgacatgcagatccgcatcgaccatcagaagaacagcatctactttggcactgatctgaccgaaagccagcgcgagtaccgacccgacgggcctgcactgcagtccatgccgtcggaacagattcgctcccagttggttaacatgtctaccgtgctgacaagggctgtttccatcgtctatccaaaccgtgaacgggaccagagggccaagctccgcacccagatggtgcaccactaccacgagatcaaggatcgcgagc

SEQ ID NO: 63 - DNA, 411 bp, Drosophila suzukii
aggacaaggagttctgggaggctaccgagaagacgcgcattgagaatgccatcaccgaacggaaggacgctgtcagccagcaggagcgtctcaaacgtatgtatcccgaccgggatgaattcctcgaggcgcttaagaaggaacgtgcttctctctatgttgaaaagctcaagaagttcgagattgccctggaggcggagcgcaaaaaacgcttggctgaccgcattgttcgacgccgagaagagcgccgccaggcttttattcgcgaaaaggaggaagagcgtctccgaaaagaggaggagattcgcttggctcaggctgccgaggaacgcgccgcagcagaggcccgccgtttagagcgtgaggccgaggacgagaagcggcgcgcacagtacgaaaagcagcgtgcca

SEQ ID NO: 64 - DNA, 926 bp, Drosophila suzukii
agcgtgccaaggaggaggaggccgagcgcaaaatcaaggaagaccgtgagcgtctagcccgggaggtggtcgtggagcgcgaacgcaccgagaaggaacgcgacacctggcgtccccgtggaagtgaccgtccaagtgcctctgccggcggtgccggggagtggcgtcgagctgcgcctgcggccagcgatcgcaacgaccggggtggggaacgtatcgagaggggaggtgaacgtatagagcgtggaggcgaacgtattgagcgtggaggagagcgcatcgaacgcggagaccgcgtcgaacgtggtggagaacgcatggaacgtggaggagaccgtgatcgcaaggacaacgaaggagcggactcctcatggcgcgtacgacgtgagccagattcccagcgtgctgctgtccccaaagacagtggagctccccaatcccgggacgacaagtggcgacgtggcggagagcgagagcgcgacttccgcaacgacggacctcgccgggatagggacgatggacctcgccgggatagggatgatggacctcgccgtgaccgtgacgatggaccgcgccgggagcgagatgatcgagatgaccgcggtggattccgtcgcaacgaaggcccacgtcgtactgaagagcctcagcgcgagactggcggcaactggcgcgacgcaccacgtcagggtgatcgtgaaaatcgccgtacgactggcgaacggcgcgatcgtgatgtgcgcgacgcacgaggggatcttcgcggacctgctcctaaagaagcagtcagtggcggcggaggcggcaactggcgtacggctcctgcacctcgcgaggaaaagcccgcagccaaacgtgatcaaccccaagacaaggagaacaaagccgccgatgatggtgaatggaccagtgtcaagcgtcgttaa

SEQ ID NO: 65 - DNA, 393 bp, Drosophila suzukii
ggtggcccggcgaagtgacactgtcgcaggactttcggttcgtcaactccaaccgcccgccattcgcagttgtggcgttcttcaatgagaagaccttcgagcaagtcagatcatcgaaactgatttacccctttcaatgcgctcacaaggaggagttcatcaaacgcggcaccaaaaaggccgatggaatgcacatgggcgacaagttcagtgacgatgtggcgatcgcagagtcgcgttatcgccgtcaccagcaggcgcccacttttcgcatcatggacatcggaggcggcggcacggcgcccccgccccgcgatcgtgccttcgacgaggccggctacgagtgcaacatgtgcaccttccgcaccaacagcatgagcgtcctgctcatcc

SEQ ID NO: 66 - DNA, 763 bp, Drosophila suzukii
accagcactgccaccagctcggcaacaggcaactatcccccacgaaagacgcgggccgcgcgacgagcccacaccaccaacagcacctccttccacaggagctctgtgcgctgccactcgcgtcacgtgtccatcgtggtggacgccccgctgacgaacgaggagcagaagatggtaaagagcattgccaagcagacgctggccagcatcgagagtgtggtgcgccccggcgaggacagctcctcgacctcggcctcggtcttcgcctccccctccgcctccatccctcctgccaccaccgatgctaaccacgtcttcgcgtcacgatgcacgctggccgccgccgccaccacggcgagtgaccaagaagtgacccccacgacaaggcggggcaatcccctgcgcaagacgctcaccactacgccaacgagcgccgagaagagaccgcggagcgcagtagggcggcgcaagcgaacgttctccaggaatagggcgcccatatctgatacgcatttctctccgccgaggctcctttcatccccaccaccggccaagcgggcggtaggtgacggaaggaaggaaaaggacaaagtggcggttctgcctgatctgactgttccgccatccaccccatcccccgaaccggtttcagaggttgacattgtgcagccgccagagaatctccggcatccgcagagcagcatcgacgcctccaagcagttgcaacttagcctgatggccgagtggggcgacgacgagacgg

SEQ ID NO: 67 - DNA, 320 bp, Drosophila suzukii
ttgacttcgaggaggaggatgacctgcagaaagagccggattggccagatggccagaatggcttaagctacaggcgtcggaccaacaccaatgccaatcgcatcgatgccaacggcaagacccattgcgaagaggacgttcctgctagggaagaggaggtgcgcacgaaagagcccgtgacagggcaggaaccccaggacaatgccacacacgaaggtatcttcaagggcttcgatgatgtccaggaacagacaatcgcagccgtcgaagttgaggcgcatgccgagcctgaaacagctgtggagcaggagcaggagccc

SEQ ID NO: 68 - DNA, 678 bp, Drosophila suzukii
agcaggagcaggagcccgagcccttggatgcagtggcggtcgaggaagcagtgcccgaggaaggagctgaaggcgataacatgagcctgcctatcaaggagcgtcaaaagcgcattttcaagtcgcgcaacaagtcgaccgtcctggcaggagcgcaggaggaggatttgctgccggtctcgctgattgccggcgatgaggaggtgtccgcccccaccattcacagccctctccaagagacgaactgcgtcacccagctgctcttcaacggcgtcagtagccggaggagcagcgcccacaacagcaacacgaacagcagcgagggtgcaatgggcagcctgagccgaagcagaaagaagcggcgcaacaaacccaagactgaatcctccccctcgaacatcgcggtcatctcggcggaggaagcccgcgagctgcaacgatccgcctcgggcgccggcatgatacacgcggccattgtggacgctacccagccggtgcagcggggcggcgtgctcatcctggaggacattcggctgccaaatttgtacgagccctttggcagcctccagtcctccgacagcaatggcagtcggctgcccgatgaggacgacgagcagtcgcaggacacgacggagcatccggaaaaaaacgatgagcaagaggatcaggaggaggagg

SEQ ID NO: 69 - DNA, 302 bp, Drosophila suzukii
aagaggaacagcaggagcatgagcaagaactggagcaggaaatggatcaggataagaagtcggaaccacagccggagcccgaagcggagagtgacctggccaactggtctccggctcgccattcacccgatgtggtgcgcatcctgccgcaggcccgcgaggtgctgctcaagaagcgcgagcaggagctgctgcgccagtacgaggccgacttggtcagcggacggagtgcggagaagtgtcgccaggcgcgcgcgcgctggagccggcccatgccgtcgcccgaagaggaggaagaggac

SEQ ID NO: 70 - DNA, 235 bp, Drosophila suzukii
gaagaggaggaagaggacgcacaggaggcagagatggaagcagatacggaagcagaggtggaaacagaggtggatgcagaggtggaagcagatgtggaagcagagatggaagcagcggagcccgctccgtcgccaaggtccgaggaggatcaactggagctgggcgtgggagagaaaaggattagttcggaaggggaattgccattggcgaccgcagaggaggaatcgggggagg

SEQ ID NO: 71 - DNA, 294 bp, Drosophila suzukii
aggaggaatcgggggaggacgaggagcagctccagctggagggaccaatggatagcaccgatctgtccttggatgagcagctggcagccgtcgagctggtgctgcccgcctcattattcccgtgctcacgtcgccccgccagccacccgcaggtcactccactgctcccgactccactcgccaccggcccaaacaagccctctcggcatctcagctgcgcccgaactcttagcgacgcggatgtggccaaggcccaccagcaactgccgcctcagctgtgcgctggacgcatct

SEQ ID NO: 72 - DNA, 599 bp, Drosophila suzukii
cagccaggtggccgagggaagtgccctggctgccggcagctatgtcaacgaggaggaggagctgtccctccacgatgaacagctgcagtccaatgtgctgcagctgaacgtcaacggtcaccgcctggatctggacccctcgatgctgtttagcattgccgagcagccggactcgtgcatcgaggtgagcgtcaccgagacgggatccggtggcaccaatgtggcaggcgccggcgcgataagagccgtgcttcaggcacgcgacatcctgcaggcggcggaggtgtacttgcaggagcgtgacctgcagctggtgaccctcgacgacgacgatgcagatgggccatcggccggcatggctgtgcccgtcacggatttgctctcccaggcgctggccggcagtcaggtggtcgacgacgactcggacttcgtgaacgcggccaacgctggcgttggcctgctccacatcgacacccgcaccggcgccagcctcctgcatgtcggcaacgatgagccgggcagtgtggtgtttatttcgcaccccatgcccccgcagaccgtgcacctgacgccgccgataacggcgcgcaccaacgaga

SEQ ID NO: 73 - DNA, 236 bp, Drosophila suzukii
cgctgctcgaccagacgccgatcatgtccacgctggagaacccgagcggcatgcagttgcgccgcgtctcgccgctggagggcaatctggaggatagcctggccgtgattggcgtgacgaacggcagcggtgtgccaacctcactggagctgcccatcacggtgaccaatccggccattgcctcgcggatgggtgcccccgtcaccgacatgctgcaattcgctccttttcagtag

SEQ ID NO: 74 - DNA, 909 bp, Drosophila suzukii
gcaaccgctcgtttgcggaccgcagctccaacattcgtcatgaaagaacccacacgaacgagcgacccttcacttgttccacctgcggcaaggcattttcctactccaatgtgctaaagaaccacatgctcacccatacgggcgagaaacctttcctgtacggcttatatattaccaattggtttcttggagcttattggcgctttggctggtgctgcacgagtctttggaagattgttgacttccggagtcaaaatggcttcgtccaattcaagctcaatttggtcatcgtcaatatcttcatgggaaatcggttccttagggaaatccttgccggtagactcagacctctcctggttctgcttctcggaaatgatgcagcgctggcggatgaggatgagaaggaggcagatgttaaaaatgaagttgatgtgggcaagttggttttgcccttgccgcccgatgaattggacgacccgttcgaggaagtcgaggaatatgaatactttgaagaatttggagatcttgatgggcttgaggaggcgaacgacgtcgaggtgggcgaagaggtggcccacgatgccgaatcgctggtctcaagtgtgcagaaggagttcgagagcatttacaacgacgaaagtaccgaagacaacaaggatttcaccgaggatccaagcaactacgatgagattgaggatgagagtgacggattctcgcaagattcatcacagcccgagtcaaagcgcgggcgaggtcgccccagaggaagtactgtcaccacggagacgacgtccacaaaacccaagcggaagaaacagtacgtcacatggaagaacttaaccgcggatcagatgatagagcggaagcggcagcagcgaaaacgcgactgcgtttgcgaacagtgcggcc

SEQ ID NO: 75 - DNA, 223 bp, Drosophila suzukii
tttgcgaacagtgcggccgacacttcaccgaccagagcaacttcaagctgcacatgcttcggcacacaggcatgaagaacttcgcctgccgggagtgtgggaagcggttttacaccgatcacctcatgtcactgcaccagaggatcgtgcaccagggcgaacggccctacgcctgccggctttgcaataagacctttcacaatagcaccactcgcgtcatcca

SEQ ID NO: 76 - DNA, 756 bp, Drosophila suzukii
cgcagccgcgcagagcgccatcctccccgataccttacaagtccagggtgcctccactttcgatgacccagattgcaccaccggaacgcagcttctattccggtaacacgctgcccagcctgctgcgctccaattccctggctggagtagtgcagaagacaagcgagcaggagcagttgtcgcgagagaaccgacccatcctgcacccaccgcatccgcagcacgagagcgaacccactaggagcgtgctggaggagctcaaggagatctcccggaagcgcatcaacactggttcgccggagcagctggccaagcgacccaactgcagctacaataacgacattgcctcctcgctgagctccagtcggcgtcatagcaacaagcggaagctgttcgacatgcgcgagagtttccaacagagtaaaaacgagacactaggcagtggaagctcacccgagaactcgcctggggaaaatgtggccaaaatacagcgtaaagtgaatgcagaatctgtcagcaagactatgagtatgcccgttccaactgttccggcagttcctgcctcgcgggccatttcggcacctcctatccaaagagcagagcagcgatctgtggaggttccgcctgcgacggaaaagcccaagcttaccctcttcaacgcgcgacagtcgcatacgaaggcggaaccaccgcgacaggatctgagcagccccgaggtggatgccggggaatatgccggcattcagttcgtgaagc

SEQ ID NO: 77 - DNA, 642 bp, Drosophila suzukii
gcattcagttcgtgaagccgaagcagcagaattccatgttgggtgttaagaatcccagcgtagagcgcacacacaagaccaagcttgctataatgctgagtggtttgaagggcgaactgtaccagggtgagccggacgaattagataacccagcgccagcctcagctccagcgccagcgcctgctacccttccaacgcccatcaaacccatcatagcgtcgcctgttactacagccacatcgaccgcgacttccactgccaccgtgtcacctacagctcccagcaagccggttatattaagtaaccagattatcaagccagcggaaacaacaaccacaagtacctcaaatgcagtgcccaaactagtgtttggtcagcctgcggcacccgcttctgcagcaggagaggcaccaaaaaccaccgacaaagtccctgcggcaccaacagaaatccctgccaagttcgaattgatagccaaacccgtaacaccagcaacatccgctcaaccattgatcaccttcggcacaccgaaatcctcagctccagccacactatcatttggaaatccctccactaccaccataactacgactactaccaccattagcactagtatgactacctcaaagcccatattctcgt

SEQ ID NO: 78 - DNA, 795 bp, Drosophila suzukii
caacagcagcaaccacaactaattcgggagcgccagtcacatcaacaacaactttcggaataactgtaccaaaatcgaccgcaactgtcgctcccacaacaactccatccataagtttcgacaagccagttccaaccatggaaggatcaggacccgccaccagcaatagtcctgcaacagcaacaatatcaccatttggagcaggagcacccgcagccaagccaatatttgcctttggacagtcgggcaatgcaagctcaggaactccgactagtagcgaaaatggacccgcagcacccaaacctgctgtatttacttttgacggcaaccccgctcaaacatctcgaatggcgccaacatcgctgtttggcagccaaccgcaagcaacaggaaactcctttggaggcgttttcaatcagcccgtggctaccaaacctgagccagctaagacgggcatctttggaaatccggagaacagctttggaaacgcatttaaaccaccagcagatgtcgcagcaacaactgccgctgacctccccaagccatttggattttcagccactacaaccgtggctagtggagccccagcggccacgaatctctttacctttggagggtcaacagcagccacttcaaagccagcggagccagctccaactaacaaccaaaacaatccctttggtcaaagtgcagccacaaccaccccctttgcgtttggaggagcagccgctccagccgcaggagctattggaaataaggataacaaatcagtgtttgcatttggaggaggaggag

SEQ ID NO: 79 - DNA, 393 bp, Drosophila suzukii
tttggaggaggaggaggagacaactcagcagccaaacccagcgcggtattcagctttggaggcacggacaagagtgctccacctgcctttggcagcgtagcaacatcggtatcttcagcaacaacggcgcctacaaacaacgcctttggatttggcacagcaccgaagacttcaacacccatgtttggcagtggaacagcccaacaaaacccggctcccgctgtggcagccaccaaaccctttgcatttggtggtgcccagcaagcaccaacatcgtcagctcctccagcttcaggaggattttcatttgccgccgttgcggcgaaaaataccacggaaaccgctggatcaaatgtatttggcagccccgccaacgccagcaagccaagcttc

SEQ ID NO: 80 - DNA, 245 bp, Drosophila suzukii
agccaagcttcaactttggtggaagcaccgtcaaccaagcaggaacagcgtcaccagcaggtggcttctcttttgccacacccaccaagaaggaggagcctgcgggcaacagcatgtttggaagtcccaacacgggaatagtgaaacctaatttcagtttttcaagcaacaatccgaccacacaatcagcagctcctagtccagcacccagctttggaggattcggagctccagcagcagcagcc

SEQ ID NO: 81 - DNA, 225 bp, Drosophila suzukii
cagcagcagcagccccagctgccacaaacaatcagaacaaacccttcgcatttggaggcaacaacacggcatctgctcccagtccagcgcagcccatgggaggcaaccttttcgccagtgcagtggcagctactcataaccaagcgaagccgggtggcttttccttcggtggagccaagagcaatgccagtacgacagccggaaacgctcccttctcgtttggag

SEQ ID NO: 82 - DNA, 207 bp, Drosophila suzukii
ctcccttctcgtttggaggagcagctgccgggggcatcgcatcaccgcccagcaatcaaagcatgaataccgcaaagccgttcagctttggtggtgctagcggcaatccgactcccaatgtctttgccagtccagccccttcgccggtggctaacaatcctgccggagccttcagcttcggtggcgctagtccggcccagcaggcga

SEQ ID NO: 83 - DNA, 215 bp, Drosophila suzukii
aggaatacttcaacatgtttggcaccgtcaccgatgtactctacttaaaggatcccgtcacccagtgaggaatctcgagtcaaggacaaggccggaagccaataaaggaaccagagcagcctgaatacctggggcccaggtaaccatagccataaccaggatgccaaaccacaggatgacgaaccagcgtcggcttagcgcagtcgcggctttgg

SEQ ID NO: 84 - DNA, 363 bp, Drosophila suzukii
tctagcaaatggtcgctaatttcgcaaacttttaaattgaagtgataagaatgataaatacggccaaatactttgctcttttagagagtttaaagtttaacaaagcactagcaaataaggcaagtaataactctgagacacccgatgccttgaaaagcaacctgttaattttagaaaaatatgccaagcttgaggttgatcagcagttgcatgaattatgcgaggaatacatggtgacagcagatcaggaatccagtatagatcccggaggggaacccataatatcctatatagtgagactggaacatgtgcttcattcgatcacgaggaatattaacttccatagcgacgccaaggaggatc

SEQ ID NO: 85 - DNA, 414 bp, Drosophila suzukii
tctacaagtcgcccatcttccatgaggcccaaggaaaagtcaaggcgaattcttccctgctgcttctgagcattcagttctttgtaaacctactgcatatccgtcagtttcacatagccaactccatggagctggttcaaagggatctcctggcggccattatgagtctacgtgtaaaggaggactccgtgcatctggaaaaggctatatcctacttctggcaacaggaatccaaagcggatttcttccgacacatcttgctcttgaaagccacaccgctatgcacacccctggccaacttattgcaccatcaactcctcgtaaagttgaattccccccaaggtttctccagctttgtggatgcgctgcaacaaactcccaatgtgagttctacaagaaatgcggaaattgtgg

SEQ ID NO: 86 - DNA, 669 bp, Drosophila suzukii
gaaatgcggaaattgtggccagcattgtggctagaaaaggattctccccacttgcacaaggaaagatgattatccaggtgttggagtattgtaaattctacctccaggatgcggacaaaatgtgtgccggtgtcctatcccttagaaggctctacgatttaaattatacaaatcagaagcagatagaagagatattatccaaacactgggaaagtcttgttaacccagaagatgtaattagtggtctgatcttaatgaatcaccaagaactctgcaatcgcatccttttgtggcaacatcttttctgctcatccagcgtggcttgtttaccaagtaacctactaattccttaccttcccctgctcctccaagtttacgatggcctaccattggaactaccagcaacatcgcagctttctgggatcatttcacgatgcctagataatagagaacgggaaaaggaattgtcaaatgtccttcaaagactttttaagtgggaagttgaagaggagcctccttggaaaagtttacacccactaattttgattctcccttcctcgaacatcaatgaaatgcaggttaaagtggcccacaaggatcaccaagtggatcatgacatgggcaggattttgcccggactgcttttatccagctctcatcattccctca

SEQ ID NO: 87 - DNA, 780 bp, Drosophila suzukii
aagactttctgcactccaagtatcaactaaaacttgacttgcttatcgcgctgaaccaattggtggctcaccaaccattgagagctcagcttgcccttcacaccaaagagttcttgcatatactgaaagacttgttggtccaccgatctggagaacaggagaccacggatcatattttgctcattgtactaaaccttttgcaggaactccttgagggcagtgaggatcttcagctctcagaaggcactaaagaactgaaggagccgttgcagcagttagggttacaatcctccaattctctcgtccaacaatctgtacaatccctgctaactataatccaaggagtatggcgaccaagtgaagcaatcaagatccaaccattccaaaaagctcgttcccttatagaggaaaagcaatcccatttgcaagtttatggcattcagatgatgatagatttgcttaagaaacgggattccgcgaccacgtcgcagggtcatctcattatagctttagctctgaccactctgaaggacaaggaatcgtacacttttctcaattgtgttcggctttttgtgtcgttagttcctgtgatggagtccgaagtgctggacaagctaagtgacgaatacttatcggagacagctgagttggattaccgactggttgtgggagaagctatcttgaaagtcgctcaggagttaggtccattttgctatcgatacaaggctgttctgctcaattgctttatgcacggctcacgctctcctgttcacgaattcc

SEQ ID NO: 88 - DNA, 460 bp, Drosophila suzukii
acgaattccggatgtcagcattcgccaatctcgcccagctatgtcgcctgttggcttatcaggtccaaaacttcttccaggagctacttcaactggtcaacagcgaattaagcacaggaagctttgtgcccgctaagagggcagctgtcttagtcttagctgaactgttgaatggcatggagaatctactggactaccaggatatgcttcttcccatttatcgcctcttacgagccatcgagtccgaggagtcctgtgatccacaaatgcgtcagcatgcagggaatggccttaaaatattaaacgagaagtgccgaaaactgattcattctagcttggaggagaattctttacaaaaacagattaaggtgctgggcatcaaagacgaagtctcacctcaaaggaagaaccgtcatatcctcgagctgaattaaaggttagcttatatacttttaaaatt

SEQ ID NO: 89 - DNA, 228 bp, Drosophila suzukii
tgcgctcctcgtcgattcccctgcagcagatgtggctgccccacaagccggtcatgctgctccatgtcaagggacgcacccatgtccaaacccgattggtggaacccgtgcacacctctctgaatcgcggcgattgctttatcctggtcgccggatcgcagctattccgctacgttggatcatttgccaacgtgattgagatctcgcgcagcaagaagatctgcgctg

SEQ ID NO: 90 - DNA, 219 bp, Drosophila suzukii
cgaacagaagcacagtgggacgcgacaggtgtgtctacttcacctggcagggtcaggactcgagtgccaacgaaaagggtgcagctgctctgctgactgtggagttggacaaggagaagggcgcccagatgcgggtttcccaaggcgatgagtgcacagcctttgtccgcctgttccgacagatgtggcagcatcgtggccgcaaggagcaatgtctgg

SEQ ID NO: 91 - DNA, 391 bp, Drosophila suzukii
gagcaatgtctggagaggcgtagccagtggagactctaccagctccagggcaacgtcaacgaagaaacccttcttaaggaagtcgactgccagtccagtcagttgcgctcccgcagctccatgcttctgatccatggcagtcagggagatgttattgtctggcatggagcaaaaagtgctcctcacacacgcaccgtggccttagaggctgctcaggaactaatcaagctggtgcccaaggatctcttcagcagcgaaactgccagcttaattgaaacggaggagggttccgaggacgagcagtgcaagaaggccttgggattgaaggagtcaagggatgactacggcagcttgctgcaatccaccaagtctttcgattaccaaataagga

SEQ ID NO: 92 - DNA, 1303 bp, Drosophila suzukii
ttctgctgctgctgttcctcgatgcgccgcttcttgcgctccagatagtcgctgacgttgtcgaagcgcttcttgaaccaaacggacaggtcctcgggaatgaagggaggtcctccctcctcggtggcgcccaggccgtctagcaccatctttagccagccctcgggcaccccgctggtcgtccgctggccagtggcgatgtcgtagacccgcaggctcaatcgctcgttctcagcgccggtgacgtagatcctgtcggcggttaaagtaaagttgctaatattccaggagcccgcctcagcacgcaccagctgcgtggccgtgacgctccaggtgtcgtcggcggagctgcgctccaagcggtacagtcccagggcgtccacgtgatcgtagaaaagcaccgccgcctggtataccttctccggctccagctgccgcaccagcagacgaaccgccggggcgggcagctcgtgctgcagcagctccttaccctggatgtagttccagacgcgcaacgtcttgtcccccgaggcggaggcgatatgccggtcagtgagcagggcaagccccgagacgaactcgcggtggcccaagcaatagctgtggatgtcgaaggtggctggatagttggtcacgcgtatcttgtcatcccggtcgcaggttatgatgtgctgctggtcctccgaccacaggatgtcgtacaccacgctcaggtggccaagcagcaggcgcggaacggcttccacttcgacgcagtcgtactggtagcaatcgcccgtcttgtccgttaccaggacggagctgctgtcgctgcagaagcgcagggcactggccgcccgggcgagagggcgggcggagagcaggcgggcgttctctggccgcgtgcgatagagcaggagcgccttctgccccccactggtggtcacggccagcagctgtccatctggcgagtaggccacgttctgcaccgcaacgtttccgtttcccgttcccgctccagatccggaagccttttcctccgactgcttgccggcagcagcagcaaggtcgggcggcagctcgatctccttgaatatctgcaggtcgtcggggttcacgaacagcaccctgcggccaaggccgaccaccagttcgggttccgcgaagaaaatcgctgccgtttccctgacgcacattgccacgattttatgaaattaatattaaaatttaatttaaattaatttaattttttccagactgtcgtttgttgtgcggttgttgttgttgttggttaaaatctccggttgtaggcaatttttcccag

SEQ ID NO: 93 - DNA, 562 bp, Drosophila suzukii
atggctcactctgacttgggtgcttcgcaggcgactacggccgaccaggatcaaggcaccacatcaaacaacggtcatgggcctaagcaaactgtgcccagcatctatcctcttggaaccccgcgaaatccgcaagctcaagccacgacgatggctctagagcaatatcgcctgcagctgtacaactacgcccttaatattgaacgatttcgatgcccccaatacggaggcaccggaggcgccggcgccggcgcaaatgctccatggctgcacctaagtccttacggaccccatgcatcaggcaatattcctgcagtaaaccgaatggccgcgctctcaaccatttcacttttcccccaaacgcaacgcatattccaacccgaggagcctaagccgcaacacagctacattggtctcatagccatggccattttgagctcaactgagatgaaaagccgcggtccggggtggaggaactccatcagacataatctctcactgaatgattgttttatcaaatctggtcgcagtgccaacggcaaggggcactactgggcaatac

SEQ ID NO: 94 - DNA, 357 bp, Drosophila suzukii
actcgcccagcccgccgcccttggatctcacaaccccacctccgcccaactcccagtccgcagtgcaactgtcgtccctgggttatccctaccaccatcagtatttaggccagttccttaatcggagctcagcacccggcctgtcacagtactcctgtgctgatccggccatagtgatgcaacgacaacaggccaaccatctggatcaggtgatccaaccagcccaagtccagcagcaacatggccagcatcagcacattgcatatatcaactctaccacgacaacgaccattgcaaacatgttttcgcagacacggaagcgtcagttcgacgtggcctcgctactggcacccgatg

SEQ ID NO: 95 - DNA, 298 bp, Drosophila suzukii
ttgatattgtctctgaagatcaagagtcctcagccaggccagcgaccacggcgaggactacgactcaaacgcatcacacagtcattaccaagcaaactatacaccgcgaagtggttttgggattggaacaacctgtgactgatgccgacattgacactgatatcgatgttgaagttaacgttgatgtggtagaagaaagtattaatcccgatcccgattcttatccggagacggacgaccaagaaaatcgcggaggaaccatgaagcaaatattttccgttgaggacaataactcgta

SEQ ID NO: 96 - DNA, 488 bp, Drosophila suzukii
gtagccaacacgaggagtctagctcactagaggaatgtccactggcagagtccactgcagggcccccaactgccgcgaggccgtccaccctggcagtagccattccaaatgcatatattgaactcaaccatgttgatccgcacatgctaagtaggtactacgggtcatacatggccgcagctgcgcgaagagctagtatagaggcgtcgaaaacaacaaggccatcttctatcacgccaccaccaaaaatcgaaatagtctcacagaagtaatagaccataatatattctattgcaacgtaatcaacaaaatattttcaaagatgtggaaagccaatgtctaaatacttaatacaaactgacgacccaccctgcaatacaaatacatacctaaatctttaattatcaaatagggttctttcaatgtagttttatattttaacaagcattaataaatgttaaactattgttaaacttcgtagatgtcaa

SEQ ID NO: 97 - DNA, 243 bp, Drosophila suzukii
atttggcggatgccatgcgtgaatccccatccacggctgccgcgcgacgtgaaaatacggctgcctctgcagatcatgcagctccttcgggtggcgaccacctggccaccggttcctcgccagccccccaggatctcctggccgccggcggcgtcggaagttcgtcctcgaattgtgataatgcctgctattacgatgccctcgccgagcacgagagcctcaacgatctggacgaggtggtgg

SEQ ID NO: 98 - DNA, 205 bp, Drosophila suzukii
acgaggtggtggaggatcaacatcagcatcagcatccggatacggagcatttgcactcgatggattccatttcagcactggcctccgttctgcccaacatttgcagctattcgcgtgtggagaaaatggtcaatcccctgggcacggtcacggatctgaatgctgggatctctggggaactgcaggcggatatgctggacgaggt

SEQ ID NO: 99 - DNA, 222 bp, Drosophila suzukii
gcgatgaggctctgttccggccagtggttgcgatcttttgcagtgatccggtggagagacaaaagcttctccagaagaatcagaagacggacgaagaaacggcatcggaactggaactggagcaggccatttgtcaaccaccagtggtgctggttaacaagttgattgtgcccgtgattgccaaggaggtggacgaggtgctcgtccagaaggagaagcaaa

SEQ ID NO: 100 - DNA, 246 bp, Drosophila suzukii
atgacaatcgacaaggagagggagaaatccaaagagaaggagctgaagctcaaggagaaagaaaaggaagcaaagcttaaggagaaagagcgagaagaaaagcttaagctcaaggaaaaagaagatagattaaaggagaaagaacgagaagagaagctcaaggaggaaaagatcaaagaaaagctgagagaagaaaagctaaaggaggaaaagatcaaggaaaagctgagagaagaaaagctcaag

SEQ ID NO: 101 - DNA, 567 bp, Drosophila suzukii
aagaaaagctcaaggagaaagaaaggcaagagaaactaaaggagaaggaacgtgaagagaagcttaaaaaggaaatggaagaaaagcttaaagaaaaggaaagagaggaaaagcttaaggaaaaggaaagagaggaaaagctaaaagaaaaggaaagagaggaaaagcttaaggaaaaagagaaagctgaaaagctcaaggatctcgaaagagaggctaagttgaaggagaaagaggtgcagaaggaaaaagaggcacagagggaaaaagaggccaaaatcaaagagaaggtggaaaaagaaaaggtgaaggagagggaaaaatcccttgaatccctcatcccagcaaacgtgaccagcccctggaggcgcgttgtcgacgagactccacccaaactgccagcggttcaggattatcccagcctgggcaagaaacccactaaggcgagtccggaaaagaagcgggatgagaaactgctgccggaactgactactcccccaaaagaagtgaaggacacgtttgaggacttcctgagcggcctaaagcccctggaggccttgccacctc

SEQ ID NO: 102 - DNA, 273 bp, Drosophila suzukii
tggaggccttgccacctcttcctgctctggaaccccttgaggtcaaagaggactccaagaaggaaacggtcagcttaatcaatttcgaaagtccgctgcaggagaagtcggcgatcccgcgaaatatttccccaccaccacggggtttcaccgaacaaaatctgatcctggccctgtgcggctccctgcactacgaaaacgaacaggaacggataaggaacacagatccagaggtgcagaccgaggtggtgaccacaccggaaccggtataca

SEQ ID NO: 103 - DNA, 214 bp, Drosophila suzukii
gcctggtgccctccgcctatgaaaagcagggatctgccaagctggagaaggcagagatccttcaactgaccgtggagcatctgaagagcttgcaatctaaaactctcgactcactgagctatgacccgcaacgagtggccatggactatcacatcatcggcttccgtgagtgcgccgccgaagtggcccgatacctggtcaccatcgagggcat

SEQ ID NO: 104 - DNA, 218 bp, Drosophila suzukii
agcaacatcaacagcaacgcacccagacaacacctcagccggcacagcagcaacactacacccatgatcacagcgtagtgcatcccgagcagcagatacccacctacatagaactgaccaacagcaacagcaatcgtccagctgccgtgggatccgagagcctcagctacagtgccgccccccagtatcccgtgagcggaggccaggactacaacaac

SEQ ID NO: 105 - DNA, 509 bp, Drosophila suzukii
attcctgtccaagaattttgttttcaattttgccctctttttgcgttgttttttgtacattaatttctgtcgtctgtagtctttgttgaagtttatatgtctacgtcgtttatgtttgtaattattaagtgcagcgattagaaggagcaacggcggtggatcacccttttcagtgccgctggcagcctgtgcacgtggccactcagcattgttgcccgccgaaacaccgaaatggtcccaaaaaaccaatttcgctgcttcgagggcaacggacacgtgtgcagctgccactggcccatcaaaagccccgaaagtcatcaatgtctgttgttgagttagcgaaagtaacgaatacacactattaagcacgcaacatttactcactccataattcaccgcacccaagacgaagaagtattgccaagccgcccaagtagctaaatttgttgaccctcaagttcagcttccacactataaaaccatataatacttaaaagaaaataaaaaaa

SEQ ID NO: 106 - DNA, 207 bp, Drosophila suzukii
aggcggtcatcaaaagcctgcttaaattttggccgaagacgcatagtcccaaggaggtgatgtttttaaacgagctagaggagctattggacgtgatcgagccggccgagtttcagaaggttatggtgccgcttttccgccagatagccaaatgcgtttcctcgccacatttccaggtggccgagcgggcgttgtactattggaaca

SEQ ID NO: 107 - DNA, 230 bp, Drosophila suzukii
gccgccgatgatctcgaccctggcgctccgtccggaccaggctctgccctccaatgatgagccccagaaacgccgctccctgctgaacttcaagagtctggactttcacctgaagtccctgtacagcggattgcgcagtcattcgggcacgggaactccgccaagccagccgaacagctcgattccagcggtggatctgacgcagcgcaggatgccctatttgcgggtgg

SEQ ID NO: 108 - DNA, 586 bp, Drosophila suzukii
atgtcgccgcatgccttcataccgcaatattggcgagcggaacgcaactgcgtggtcttcttcaccgacgactacgagttggccgaacgcatccagcatctgggcaagcatgcccagctacccgatggatacaggctaatgccacgcgtgcgcagcggcattccactggtggccatcgacgatgcttttaaggaggcaatgaaggtgaccatggccaagcgttataatgtccagaccaaggcactggatctctcccgcttccatgccgatcccgatctcaggcagaccttttgcccactcttccgtcaaaatgtgatgagcgccgccatcgacattatctgcgacaatatacccgatctggaggccattaacctgaatgagaacaacatgaccagtatggaggccttcaaaggggtggagaagcgcataccgaacctcaagatactatatttgggtgacaataagataccatcactggcccaccttgtcgtgtttcgcaatctgtccattctggaactggtcttaaagaacaatccgtgtcgtgcccgctataaggattctcagcattttatcagcgaagtacgtc

SEQ ID NO: 109 - DNA, 270 bp, Drosophila suzukii
accagtacttccgcatattcgattcggacaaccgtcaatccctgctggatgcctaccacgagaacgcaatgttgtccataacgatgccgtcggccaatcaggcgggcagtaggctgaacagcttctggaaattcaatcgcaacctgcgtcgtttggtaaacggcgaagacaaccgcactcgccacctgaagtacggacgcctggcctgcgtttccacgctggacgaatggccaaagacgatccacgagcgtcgcaccttcaccgtcgacc

SEQ ID NO: 110 - DNA, 205 bp, Drosophila suzukii
gcacctacgtggtggtgccgcagaacaccggctattgcattcgcaacgagaccatcttcatcacgaacgcctcgcaggagcaggtgcgtgagttcaagcgctcgcagcaccagccggctccgggggccatggggagcacttcgagcagtgccacggcgaccagtgcgcattcgcagcccgtgacgacgggtctgcagggtcgtct

SEQ ID NO: 111 - DNA, 245 bp, Drosophila suzukii
tctgcagggtcgtctgaatccggtgggcgtggcgactggaccggtggccattctgccaggcgggccgattacatccagcgcaccggtgagcagcggcagtaccgccatttcggcaggaacagtagctccgggcgccccagcaggtggtatccaggatgaaaacaccagaatgcagatgatccaagccatgagcgcgcaaagccaaatgaatgtgctctggagccgcaaatgcctggaggaaacga

SEQ ID NO: 112 - DNA, 243 bp, Drosophila suzukii
ggattgcctttaacgatttcctatatctgatgcgtcagaaaatggccgaaaaggactccaatcaggacatgatgaaggccttctcctttttcgatgacgatcgcactgggagcatctcctttgccaatctaaaacgcgttgccaaggaactgggtgaacaacttaccgacgaagaattacaggagatgatcgatgaggccgatttgaatggcgacggcgagagtgacacgcccagcttgtcgg

SEQ ID NO: 113 - DNA, 217 bp, Drosophila suzukii
atgttgccccatttgagcgccgacgagggacagccgtccatgacgcggaaggtgtacatcaatcccaatttccatctgcaaggtcaaactgcgcatcagctgccctttcaagtgcccttccaggcgccacctcagccacagcccgcgatccacatcaatccgcacttcttgcagcgccagcaggccatgtacgagcagttccagcggcagcagcagg

SEQ ID NO: 114 - DNA, 204 bp, Drosophila suzukii
agcctccattggtaagcatatccaagcgaaagattgtgcgccaaggagctgtgaagtccacgacagcggcttctgccccacatcctcctccacctcagccgcctgccaaacgcacgaggtacaaactagtgcgctccatatcgctcacctgtacgccactcgtcaagaagcgtcgttctctgaaagagtttgtgggccagtacg

SEQ ID NO: 115 - DNA, 216 bp, Drosophila suzukii
caactgctgctgcggctccccagataagcgtgaaccgtagcatcctgcgacgcatcgacatcggcggtcttacctatgtggcttcacccaagactcagaatgtcttcatacgcaccactaatcacgtgtcgcgggcccacctgatcactgccaggcagagaagtctgacgctgctcaacaagtcgttggtgaagactaatgtgccttgtgccatct

SEQ ID NO: 116 - DNA, 341 bp, Drosophila suzukii
agcgcaagggcaagtgcgagttgtccaattgtgtgttctgcaagaagcagccatcgaagaggttggtcatatcgcggccgaaagcggccagtaaacctcgaggcatcccggagacaccgaaggagcctgccaaggaggatgatttgcccaccagttcacggtattttgggtgccataaagaaccgacagaagtaatattgccaaaagatgacgtgaggaaggaagagatcgaagtggagaaagaggacccagcggagacgggagccactcgacttggccgacgaccacagctgggcaccctgccctcttttattcccctgggcggcgaagaggaattgtaa

SEQ ID NO: 117 - DNA, 336 bp, Drosophila suzukii
agtacgccaccgccatggaaaacctcaaacacattttcaacgtggacgccagcgtccagaagacaatggcgctgatcgaagacgacaagctgctcaacgcccaccagtgtctggcggatctggagaactcgcgcgatgatctcctatacgagctgcacaaacagccaaagcagcacgcctccgacaagatcacacttaagcggcacttcgagaaggtggacaccgtgtctcaggagctggagaaaaggctgcgcctgatcctcagccgtacgctaaacactttgcgcaagaagcccacaatcatagtcaccgctctgcgcatcatagagcgggaag

SEQ ID NO: 118 - DNA, 291 bp, Drosophila suzukii
gcttcccgccgcactacgatatattcggggagtacgttaagttctaccacgagggactctctagctatcttgataacatcgtgcgctccggcttagagggaaatgaatatgtttctatgatggcgtgggtcacgcacacgtatccaggcgtagagctgatgtcccaccccgatcttaacgtggatgtacatcgactgataggaactctattgcgccctgagcatctgaaggcgttggaggatgagtacctgcagaatatgcaacgcaactttcaggaatggatgaccaagg

SEQ ID NO: 119 - DNA, 309 bp, Drosophila suzukii
ccgagtgcgatgccattacccggaaaatcaaaacggaagctaagcgatttaagctgttcttcgagaagatagctcctaaaatatcccttagtgactctccactggatctaatatccacgctatcagcactgctcatctcggatattgagctccttgttttggatctgcacacgttgctgggaagctatccctccctaaatgaggaccacctggtgcggctcttctatatccgaaacgatgtaaaggcggcggaggtgcgagaaaaggtgcaggacgctatgaagtcgaaaaaggcaatggtcagcatcg

SEQ ID NO: 120 - DNA, 559 bp, Drosophila suzukii
gaggaggaggagcagccagccgtctgcaagattcgcattgtgccgctagagaagctgctggctagtcctaaaatcaaggagaagccttcccgcaggagtagtacgaagaagattactttgattgagagttccagcgacagcgaggagcttctgaaaaggatcccatcccccttgccagcgcgtaaaagaagcgctgctatcatagaactgagcgacagcgaggaggaggacgaagcggaacctgtactagtggccaatcccttgcgcaaaagacgggacaaggatagccagcaaagtaaacccgaggaagtcaccagtaaacagccggagcaggccagcacatccagcggggcagttaaagaagccaccaagaacggcaatcgcacacatcggggctctctgaccagcgagagatcttcgaaagccagctcaccaagagccgaatcacctccgaggcccaaacgctgtgtggtgcgcttgaagcgtgtcagcctgcccaagccaaagcccgcccagaagcccaggaaaatgagcaccgactcggaagaggcggccacca

SEQ ID NO: 121 - DNA, 246 bp, Drosophila suzukii
ggccaaagaggaggatgaccgaaggaagcgtatcgaggaccgccagaagctgtacaaccgcatctttgtcaagtccgagagcgtagagatcaacgagctggttctagacttcgacgcggattccaagaaggccctgctgcaggtggacaaggggctgttgaagaagctgaagccgcatcaggtggcgggcgtgaagttcatgtgggatgcctgcttcgagacactccaggagagccaggagaagcc

SEQ ID NO: 122 - DNA, 228 bp, Drosophila suzukii
acattctgcacaagctgctcgagggctgcatccaacggcgggattactccgtcctggcgccttatttgccgccgaagcacgagtacgtggtctacacaacgctgtcggagttgcagcagaagctctatggctactacatgaccacgcaccgggaacaaagcggctctgatgtagtcggcaagggggcgcgactatttcaggactttcaggatctgcggcgcatctgga

SEQ ID NO: 123 - DNA, 212 bp, Drosophila suzukii
atcccctgctctacgccaatcagcatcccaatgcggctggctacaatcagggcactggcggtccgccggggccggctggatcgatgccccccggtccacatgccgcacctgctccgggcttcgagccggacaaggtatacgagatcgattaagatacacccgattcgcggaaccaacggaatgtggttgcactctttaatttaatcgtaggt

SEQ ID NO: 124 - DNA, 386 bp, Drosophila suzukii
cagcagcagcagcacatccggaaacaatggcatgcaacagaaagctagctccgctctgagggtgattgtcccagcggagctacagggtgtggcctacatcaaggtgatcacgcagaaggatcaggaggacctttgtaccgcccaggttaatctaatgggccacggacccaacataaccgcacaggtgggcgtgtggcaaaagaccttggagtttgcccaaaatgtgcttttctgcaaggagctgtttgctcagttggctcgcgaagccatccagctccaggcacccattccacatgtggtcattggcaaccagattcgagccaccctgctgcccaatatccagctgatcatctcattgtgccactcgaccaccttcgattccagcc

SEQ ID NO: 125 - DNA, 263 bp, Drosophila suzukii
gcatgattgccgttcagatccgctgcgatccacagatagatgttaaggtctatatagccagaagtccacgccaggacttcttccccagtccactggtaccggagaaattgtgggaaaatctgggcggcaattttaaagaggtgcggttcgacaaaatcgagggcaagagcttcctcaataaaatggaatttctgatggcttcattgaccagcaactcagcttagaaagctctacacgcatccactagtgaataaatcgattta

SEQ ID NO: 126 - DNA, 262 bp, Drosophila suzukii
gatccaatcacactgaacggcagcagttccaatggagtggtcggtattggccagagcccctcaactttggtaggaggaggaggaagtggaagcggaggagcaccaggagttgcagcaagcggtgctgcaacaacgggagtgggaggagccggatctggaggagcattaccacctgggccaggagtcggatcgggccagggaggaggagtcgtgggaccaactaccgccacgggcaacccatccgccagcttcggtggcaacg

SEQ ID NO: 127 - DNA, 232 bp, Drosophila suzukii
tggagctggccaaactgcaaaatctgcagcgcatcaatacgttaaagctactgcaggcccaaacgcagcagatgcctctgatcaatcagttgttgcagagttatgccgggagcacgatgagcagtgtcccgggaaccaatctcggtagcttgatgagtacggccggagcgtccatcgtgtcggatatgacgggaaacggtggtggcaatggctccaccaacgatggccacct

SEQ ID NO: 128 - DNA, 231 bp, Drosophila suzukii
acttcttcaaaatctcttcacgccgcatcaagtccaaggatgttgaggtcattccctggataattgccgactctaattttgtgcgctcaagctcccagaaactagaccccacgaagaccgtttttgtgggcgccctgcacggcaaactgactgctgagggcttgggaaaaatcatggacgatcttttcgacggtgtcctgtatgccggcattgatacggacaagtacaagt

SEQ ID NO: 129 - DNA, 229 bp, Drosophila suzukii
aaactggatttcgtcgggcagaatattctaccatcgagtttctcaagcagctaatagagtgcaagccatgaaagtttccggaaaaacagcgaaaacgagtatctagcaaggatttgagaaggaaacttcttgccctgtgtgtgtgtgtgcagtacgtgtgcctgtgtgcgtgaagaaggaggaggtggagtggagacggaggagaggagtttttcgcagggaaattacg

SEQ ID NO: 130 - DNA, 226 bp, Drosophila suzukii
gtcagatgcaaggtgccggcggcggtggctcctctgttcctccgcccgtccacgcccagcaaaatggctatgtgtcgcagccgggatccgcaggtacagctcccgttggaggaggcggtgtctttggtacagctcagcccaccgcgcagcaggcacagcaaccaccgaccggagtgcaagccaatgctggatcagctggggcccaagccggcggaggaggcggtgc

SEQ ID NO: 131 - DNA, 376 bp, Drosophila suzukii
atcatggtagtcaaggagattccgcttcacgagaatctaagcatggagaaccgctccacaaatgccgccacgcccaccacaacgaccactttctcgcgagtggggcgtcgatatagtgtatccctgaccactgccatcctgctggcctccttttttatctgcactctacttgcggtgggtttcattgtctataactttgccacgtgtgctgagctggagccatcagccgacgaagacatagtctgcaccagtgttcatctaaggaagctgaaagctggacaagatggaacaccgaaatacgatcgggatgtccgtctaccgcgctctatccgccctctgaaatacaatatcacgctggaaccgcagctcagcggca

SEQ ID NO: 132 - DNA, 276 bp, Drosophila suzukii
ttcgcatgatggcccactttctcacgaatccagttttccgccgtggtcttagcaaatatcttcaggagatggcctataattccgcaacgcaggacgatctgtggcgtttccttacaaacgaggcaaagtcctctggattgctggaccacagcagaagtgtcaaggagatcatggacacgtggacactacaaacgggatatccggtcgtcaaggtatcgaagcatcccaactcctatgtgatccgcctggagcaggttcgctttgtgtacaccaaca

SEQ ID NO: 133 - DNA, 300 bp, Drosophila suzukii
tgatcgatgatgtgatgaacttggccaggggctcttatctttcctacgaaaccgcgatgaatttgacccgctaccttggtcacgaactgggtcacgtgccatggaaggctgcgagcagcaacttcatttttattgactccatgtttgtgaactccggagattatgacctgctcaagaactatctgctaaagcagctgaagaaggtttacgatcaggacttcttcaatgttacattccccttgccgaagatcgatatgattgctctgccggagttccaagcgggtgctatggagaattggg

SEQ ID NO: 134 - DNA, 202 bp, Drosophila suzukii
ctaaacgagggattcgccagctatatggagtatctaacagcggatgcagttgcgcccgagtggaagcagctggaccagtttgtggtcaatgagctgcaaacagtgttccagctagatgccctctccacatcccacaagatctcccatgaagtatttaatccgcaggagattacagagatatttgatagaatttcctacgcca

SEQ ID NO: 135 - DNA, 435 bp, Drosophila suzukii
gaatttcctacgccaagggatcgactattattcgaatgatggcccactttctcacgaatccagtttttcgccgtggtcttagcaaatatcttcaggagatggcctataattccgcaacgcaggacgatctgtggcgtttccttacaaacgaggcaaagtcctctggattgctggaccacagcagaagtgtcaaggagatcatggacacgtggacactacaaacgggatatccggtcgtcaaggtatcgaagcatcccaactcctatgtgatccgcctggagcaggttcgcgctgccaagtacggagaagcccaggttcagatctggcgccgtagcttcgacaccccaccaccaccaatggagccgggccatccctactacgacaacattgtcaaggatgcccgctacgccgacggacccaagcccgaggagttcc

SEQ ID NO: 136 - DNA, 276 bp, Drosophila suzukii
ttcgcatgatggcccactttctcacgaatccagttttccgccgtggtcttagcaaatatcttcaggagatggcctataattccgcaacgcaggacgatctgtggcgtttccttacaaacgaggccaagtcctctggattgctggaccacagcagaagtgtcaaggagattatggacacgtggacactgcaaacgggatatccggtcgtcaaggtatcgaggcatcccaactcctatgtgatccgcctggagcaggttcgctttgtgtacaccaaca

SEQ ID NO: 137 - DNA, 270 bp, Drosophila suzukii
tgatcgatgatgtgatgaacttggccaggggctcttatctttcctacgaaaccgcgatgaatttgacccgctaccttggtcacgaactgggtcacgtgccatggaaggctgcgagcagcaacttcatttttattgactccatgtttgtgaactccggagattatgacctgctcaagaactatctgctaaagcagctgaagaaggtttacgatcaggtgggattcgaggactcgcagggcgaggcggagaatatcctggtgaagctgaagc

SEQ ID NO: 138 - DNA, 247 bp, Drosophila suzukii
ccaaggagccctggttgctgtatcgctacttgcgtcgcggcatcgccggacaacatatacggaaacaggatctgttccgggtatttgctgcagtttccagtacggtagtcggccaacagatagcttttgatttcctgcgcaacaactggcaagagattaagacctacatgggctctcagatttccaacatccacacgctttttaagttcgccacaaagcgtttcaacaccaagttccagctgggcga

SEQ ID NO: 139 - DNA, 204 bp, Drosophila suzukii
tgaacaagaactacaagtcaatcgttacgtggttacagaaggaggcgcaggccactgtaccaagccagtggtacaaggtgaagggattccggaagtatatgatcgaaaagaccagcgagatgaacttgcggagtgttaagatcaaagtaaccgtcagtgagctgcattctgtggtcagaggactgggtctcgctggcatgggca

SEQ ID NO: 140 - DNA, 258 bp, Drosophila suzukii
acaaggccatccgcaagcttctccatgttgccgtatccgatgtgaatgacgatgtgcgacgcgctgcggtcactgccatcggttttatcctgttccgcactccggaacagtgtccctcggtgatcggttgtatttggttttattttatgggtatagctgatgacaaggtggagcgcacaatcgattctctcaacgaagtggagaagcttcatcagaagaacattgagaagcttatatcaatcctctccggcgaggttt

SEQ ID NO: 141 - DNA, 228 bp, Drosophila suzukii
aacaggcagcagcggcggcactgcccgtggccaccgcatcatcggcttctgggaactcggcggcagtgaatacatcaacagccacctccgtgagtatcaacaatacgagcctgggaggaggagtaggcagcggagtcaacagttcgcccactgccgcagcggacagcttcgaggagcggatgaactacttcaagatccgcgaggcggagctgcgctgcaaggagcagc

SEQ ID NO: 142 - DNA, 402 bp, Drosophila suzukii
cgcaacattccatgctgcaaaatgcagcggccgaagaatcctcaccaggatccgtggccggacgtccctggttgccgctgtacaatcagcccctcgatgtggaggccctcaccgtattgatacgtcagcatcagagtcaagtgcgtgcacccctgctactgcacatccggaaactgaaggccgagcgttgggtgtacaaccagggattggtggaaaaatacctcaaggaccaggccgattggcagcgccgttgcgagcgcatggaggcgagtgccaagcggaaagcacgagaggccaagaatcgtgagttcttcgagaaggtcttcacggagctgcggaaacagcgtgaggataaggagcgcttcaatcgcgttggatcgcgcattaaatccgaagcggatc

SEQ ID NO: 143 - DNA, 266 bp, Drosophila suzukii
gaccgagaattacaagcagttgttgcgcaaatcccgccagcggacgcgtagctcgcgtaatcctgccaaggcccaggctgctcagccgcagtgcatcattgattcgatgaccacgggcgtgatgacgcgtctgcagcgtgaacagcagcaaaagtccggtggtcgttcatctgccgttgcggaacgtgagcgtgccgaacgggcggcagagcgggaacgtgtggcggagaaagcggcagcggatgcggccaaagcggctgaaagtg

SEQ ID NO: 144 - DNA, 479 bp, Drosophila suzukii
ggcggcgaggccaagagcagattcgcgggcggaagccaacgatccgctgggcaaaacaggtccaaaagctatcaacgccgagggctataatgccactggtggcaacaccgctagcaacgctactccagccgctgccccggcacagggcgtaaccctgaatggctttaagccgggctaccagactgtggtcatggccaatgtgaaggccagtgctgaggattcggcgagcggaggagctgctccgacgacgaatgcggccggaacagggcagggaggcgataaaatcgccaagcaaacaccgccatccagggctccgaattccacatcctcgacggcggcgggtgaaagtggagctggagtgcccacttttgcccacaccgccaccacggcgggcaactatctgggccagaagctaaaggcggcccaggtcgagggattgggagctggcaatgatctgcactcggatgttagtgaatcca

SEQ ID NO: 145 - DNA, 311 bp, Drosophila suzukii
aggccaatgccaaggatggctcgatggccaagacatcgctgccatcggcatcatcggcatcggttgtcacatccacgccatcggcatcctcctctggctccatgctgctgatcagtgccgcctccatcatgtccaccgcagcgggagccacatcctcgagcacggcaaccaccacggccacggctccatcgatctccatgcccccactgttggcagatgggagcgccaattcgatggtcaacgcttccgaggtcctcgccctcgatggcaaagtgatatttaatctttcaactacttttccagtagggtaa

SEQ ID NO: 146 - DNA, 270 bp, Drosophila suzukii
gtccaaagcgcctgatctacggcagcaccgccacagccggtccaacgggcagtaccgcctgtccaccgccggcaccgcctccttccgttcagtatattgccaccgggtcgagcggtggcttccttaatggcgccggcgccatttccggaatcgcagcgggtcgagggcccctgcagctggcctactacggtgccgcccccccgagcactgcccccccgacggcgacggccctttccaacgcccccgaaacgtacgaaccgccaaccgctc

SEQ ID NO: 147 - DNA, 207 bp, Drosophila suzukii
atttccagctctagcagaaagacgtcggtcgtagtctgaatcggtgtgaattatattattattcgcactaatgtgataaaaaactagacgaacgcgagtggtcgtaataatcgcgcaaatattgcctgcagaagttaagtggtaaacatgacacaataaattagtgacaaaccaagcaacgacgatcgaaacgggtctaatttttat

SEQ ID NO: 148 - DNA, 302 bp, Drosophila suzukii
aaagtgtaccttcgttatctgaagatccaacaccgttggccgagtccattaatcaattgcattttgaactagaaggcgacggcaaaggcgaggctgcgagcaagttagacttgagcacagcaaccggagcaaccggtggtcttagtagtgccgacgagtccctcaaaactcccaatggactgcagcccctggtggacagtacgcccattaagtcacctggggaggtgaggcagccggccaagcaaacacctgtggagccagcgaggtcgaagaccatcgagacctttgacaaaatggtcacc

SEQ ID NO: 149 - DNA, 306 bp, Drosophila suzukii
aaatggtcacctcaacgccgctggaacccaaagcaagcaaagatgatgcgaagccaaagaagaaaagggccttgttcttcaccgagaaggatgatgagcaggatttgagggtgacgagtctcaaggaggagagtggcgacagcagcaccaaaaaggaaacgaccaaagaggagaacaagtccgctaaggaggcctcatctgtggtggtggtgccaccgagtgtcaagcgccccgagctgcagcccctgaacctgaagaagagctacgaaccctcgccgactcctgcgcccgcacccgcactcgcac

SEQ ID NO: 150 - DNA, 200 bp, Drosophila suzukii
gcatggccttctgcgctatcatccatcactttgcgcctgagctcattgacatgtcccagctgagtgcccatgatgtggtgggcaactgtcggattgccttcgatgcggcggaatccttgggaataccccgcgtaatcgagccacgggaaatgaacatgctgacagtgccggacaagttgggcgtgatgacctatttgcat

SEQ ID NO: 151 - DNA, 200 bp, Drosophila suzukii
tcggacaatttgtcgcagagtcgcatcgtcttttcgcacccgaagagtttgctgctgcatcaaaactccatcgatgaggagatcatgggacacaacaagtcagagcaactgtcgcccactaggaaaaaggatgtgaagaatcagattctgaacaactcgaagaacatactggacaaggtgatgtcgcccaccaaggacaa

SEQ ID NO: 152 - DNA, 218 bp, Drosophila suzukii
cgctctcctcgcagcagtcctcctgcgacaatctgcccgcgtgcagcgaggatgacgaggtcctggcgctggcgatccattgagctgctctgccaatcgcttttgccgatgcactgccacgcctcaccgcctgactgccagcccgcccagatcttccggatcgcccgcctttccgcctgcccgagagaccgaggaaacggaggagcaactgctatcgc

SEQ ID NO: 153 - DNA, 239 bp, Drosophila suzukii
cgcttcatccaaaaatacatgtacacttatatatttattaattacctttatgcgaagacctatttaaccatacttaattgagaatactacttattcttagaaacaaaaatgtacccttatatatttgtgaattacctttttgcaaaaacgtatttcagcatacttaagttcaacaaagcgctttaatagtaatttaaaggtggcttatgtatatacttatatttatatttataattatt

SEQ ID NO: 154 - DNA, 394 bp, Drosophila suzukii
atgttcttctccaattacaataatatgtacttgaagaactattgctatagccacagtggaggcggcggtgggggaggcggcactctgcccgccttccagcggatcgcatccgtcagcagtggctacgtgagcggcgtggccaatggctcggtcagtggcgccgaacgctacgcaccaatgagcaattaccgcagtcagaacgaagcctggttcgatcaaatggggggctactcctcggggggacagccgcaactgggcgtcggagttggacccggagtggtcaccaatgtgatacggaatggcagggccatctcggcggccaatgcagcagccgccgcggcagtggatggatcaactcctggagccttcctctcagcctcggcatcgttgtcag

SEQ ID NO: 155 - DNA, 226 bp, Drosophila suzukii
cccacgcccacgcccacgccggcgattttgggaggagtggtggtcagtggtcacagcagtccggtgacaggacccaaacgaaatctgggtatggtggtgccaccaccggtggtcccaccgccactggcgcagcggggagcgatgccactgccacgcggggaatccccaccgccggtgcccatgccaccactggccagcatgcccatgaatctgccgatgagtgcgt

SEQ ID NO: 156 - DNA, 235 bp, Drosophila suzukii
acgatcagaacgacaacatccggatcatacagattgaaaagtccacagagccactgggcgccaccgtgcgcaacgaaggcgaggcggtggtcatcggaaggattgtccgtggtggagcggcagagaagtcgggacttctgcacgagggcgacgagatcctggaggtcaatggtcaggagttgcggggcaagacggtgaacgaggtgtgcgccctactgggcgccatgcaaggcac

SEQ ID NO: 157 - DNA, 303 bp, Drosophila suzukii
cactcccgcgaggggtggcaacgctaggcgggggaacagctgatgcaatagcaaaaacgtggagatgctgatgaagtgaatttgtctgagagtcccgagaacgccaggaaagttttgcggcccccacgaagagcgccaaaataagccccaaaatacgtactgagtcagccgaagagaacgccccctcccgttcgcgacgataggcagaagcccgctctctcgttagaggtataaagtcagaaagccgtgaaaagagtgcgctctttttctacagaaccgtcaccaagataggacgtgtgttgg

SEQ ID NO: 158 - DNA, 222 bp, Drosophila suzukii
acaactgactagacgctgacgcgccgcttccgcagtcaccatgtgctaaaaggtcgaagacatcgttatcgccatcagcgtcaacatcaatagaaaccacaacaccaacgtaatttttagtttcgtttttaaagttaaaagtcgggaagccagccacatcggcctgcgtcctgctttgggctttcgtttcttaccgcacctgcgctcttcgctatataattt

SEQ ID NO: 159 - DNA, 275 bp, Drosophila suzukii
attgatgagctttagttatacatatacatagtatagagtcgctcagttttgttatcacaaaaattgaagaagtagttagtctgcccttcaaataccctgcaatgtaattcagttggcatctattgaaattgtataaaactaatatccgctgcctagaaattgtgcaccattctcatgccctaattgtacacaaatttttgtaacttttaatattgctatatgttgtcgtatgcgttgtatatgtttaaccaaaagtttttaaacaactcgattgt

SEQ ID NO: 160 - DNA, 233 bp, Drosophila suzukii
caaaaatatattaaaaatacagataaaatgattgtaatgcatacaagacctgtatgcacagaccaggacgtttttgttgctaaaacaacaggatcggcgtcttgcgttgcaatttattaacagacaaattaaacagtcatccagttcaaactatttccggtatttgacacaagggccgcaagaggcgcccataaaatagttaaatctgaaatattgtaatatttaaaatatgt

SEQ ID NO: 161 - DNA, 488 bp, Drosophila suzukii
gtaatatttaaaatatgtacaagtcaagcaaactttcacatgacaatgatcattgcaataaacttaaccgacagttttaattaaaaaatgctttgtttccagtagtcgtaccttattttgacaaagctttattgtgttgtgttactatactgataagtgtacaagtagggcatgaattcaaattaaagtcttaaatagccgttatccaacgaatttgcagtgtttaaaaacaccaactttggatgcatacaatttggtatttaaaatactgcaaagtcccagctaaaatttcctaatgcttcaaagcctatcgatagttttaatacactgcaagttccggcgaaaacgactaatagaggtgcagaaacatcgatgtttgcacacatcgatgttctttcaaaaaacatcgatggattctataattgtattataaaatataattttaaaaatattggtggaatttgtattaaaaataaaaaaaacaatta

SEQ ID NO: 162 - DNA, 237 bp, Drosophila suzukii
tcaacgatctgtgcaagtcctgtgccgccgggaagatcaagaccctcaaggagattaacattgcatttttgccctacgaatgccaggtgttttcgctggactcaccggatacattccagtgcctgtactccccggcctttgcctccataaggagcaagcacatcgagcggattgccgagcagatagccactttgtgcgccaccctgggggagtaccccaatgtgcgctaccgcagcg

SEQ ID NO: 163 - DNA, 414 bp, Drosophila suzukii
atttatgagctaaaaaggagtctggacaccgccctggcggcggaatcgtatttaacccaggagctggaacagctcagcagccaaccggtggccagtaactccggcggggatgcgcaggaactagaggagctgcgtcggaagtacaaggcgctcaaagaggaacaggacaccttgcagcaggactacgaatccaaggtggaggagtccagccaactaaagaacaaactggctgccgctgaacgggaactggcggataagtcagctgccaggacaagtgatccccacgaggattgcttggcgcgcttgaatgccctggaacaggagaactgcgagctgatgcaaaaactggccgaatacgaggatgcgcgggtcaacaacacccttgcgttggccgaaaaagagaaaaccattgag

SEQ ID NO: 164 - DNA, 738 bp, Drosophila suzukii
cgcagctgcatagcatgcgcatccagaaggctggactggaggaacgaatgcgatccgtgcagcaggaaatggcacgttggcgctttgagtccctgaaatctcgctgcgtgctaattgaccgcgaaaatcttctgacggagcacaagatcggtttcaaaccgatgcaggccatggagttcaacatcaaggaagcggagctaaaagctgcgttgcctcgcattgtcagtgtagccccgtcatctccctctaaatcagctcaattatctgaagcaatatccacttcaacatctcttccaaaaccaactgaaataatacttctcgatacacccataaaaccagctgttaaagaagaagtagtggagcctcttaaacccgcattaaaacccgctctaaaaggaacacctgtaaaagtcaaacaggaatctaaagaaaccgaaatcaagcctatgacaaacagtacacccattaagactattatgggtgttaaaataaaaagggaagtcaacttaaacttggagcatagtgtccacgtcaacatcaaaaaagaaacggcggtaaataccgaaatggaagaatcggaaataattccaaagcccaagatgaaaggcacacctgtcaaacccgatttcagtcttataaaaatagaaagtaatgaaggaacgcctataaacctaagtgaaaccgaagaagatgaccagaaaactagcgaaaccccggctaaacctttgatgaagggta

SEQ ID NO: 165 - DNA, 348 bp, Drosophila suzukii
aacctttgatgaagggtactccaattaagcagcgcttgggaggcataaaagtaaagtccaatgaaattttgctggagacgcctgctaagccgcagcgcaagggaactccagttaagctagtaaagctgcaagccgaaactgaagacagcggtgaagagtcgtttaaggaaacttccttgaaggcagatgaaatcgattgcgtggaagtcctggatagaacggcgccacaaaagccgcaacgcaaaggaactcctgtaaagattcctgtcatgaaagacggtactaacagcaatgtgcgctctatcctgtccaaaaaacgggaagtctttgccgaagattcgcaaaagg

SEQ ID NO: 166 - DNA, 301 bp, Drosophila suzukii
ccgaagattcgcaaaaggcggtcaaatttagtgcaaatgatccgattgtccacaatttaagtcctctcgaaagatgccaacgtgaagagctcgccaaggaaaacacaaagccaacggaaacggaagaatccaacgacattaaacccacaatcaagaggccaaacatcataaggcgtatcgttttgagctcccgaaaaccaactatgaaatgattgcatctgttttctaatggaaactttaattcgaatttatactaaggcactcttaacaataaattacacagctacagcagagaaataca

SEQ ID NO: 167 - DNA, 317 bp, Drosophila suzukii
gcaatagcaccagcagcgaggctaccagcgaggacatcgactccagcagggagcatctgaacaagcccaagggcaattcgggcggtggtaacggcggcaacggttgcaacaaccatgttgcaggcgtcaaaaggtgccgctctaagcgaaataagaaatcgtccggccaacatatccgtaatcctgaccagatgggccagaaggccgaaggccctgcctctattgtgggccaaaagaccaagcagacaaccaatggcaagtggcgccaacagcagcccaatcccaacggcaacaacccacagcagcaccaccagcag

SEQ ID NO: 168 - DNA, 262 bp, Drosophila suzukii
tcgccagaatgccaacttcttggtgcccccactccggcagtacgagcaattggatctggacgataagaccctggtgcagcagctccggcgacatgtcatcgatcaccatctgctaagagtctacggctttccggtggagtccgtggtccatgagggcgccatcgagatcttcaagtgcctgccgcacatgagtttcgcagcggccctggcggaaactgccccggcagtcacactgattaactgccacgacggactgaccaac

SEQ ID NO: 169 - DNA, 280 bp, Drosophila suzukii
acgacggactgaccaaccgagttgctgttgaggaggaggtggccacctcgagtgactccggcaacagttctccccgctctctggactccgagtccggaggtgagtggagcggcagcgaatgcgagtcctccaactcatcatcatcgtccgcctcctcaacaggcgatgccgaacttagtctggagcttaagtactgccagtacgtccaggtggagcgcagtctggccaagccgtgtgcccgctgcaagcgtcacttcctggtggacgagctgacgggcga

SEQ ID NO: 170 - DNA, 248 bp, Drosophila suzukii
gagtctggccgaggtgcaacgggatctcctcgagctgattgcggcggacaccatactgattggacacggactggataacgatctacgcgccctgcgcctggtacacaacaccttgatcgatacctcgatcagtttcccgcactgcagtgggtttccataccgccgggcactgcgccacctgaccaaggtccatctgaagcgggagatccagtgtggtgatgggaccacaggacacagcagcttcgagg

SEQ ID NO: 171 - DNA, 242 bp, Drosophila suzukii
gctccaggcacaggctcagcgtgaaagggagcaaagggagcgggaacgagatcagcagaagctaaccaatggcaatcccagccggcagttgcccccaccaccgccgtatcaaagcaacaacaacagcagcgaaatcaaaccacccagctgcaataacaataacgtacaaataagcaacagcaatttggcgacgacaccgcccataccgcctgctaaatacaacaacaactcctccaacacgg

SEQ ID NO: 172 - DNA, 206 bp, Drosophila suzukii
tgcatctgcatctgcaactgcaactgcatccgcatccatgtccacggctccgttgcttatgccggtgacgctgcagagcgccgcccagcagctgcgctttttcagacgctactcctataatccactgcctgcgattcccatcaaagatgagcccattgacacggatgacgactaccagatgaagtcaatagacgagtccgatgaca

SEQ ID NO: 173 - DNA, 300 bp, Drosophila suzukii
tctcgcatctgaagaagcgcaattgcatcaatctctttagggtcttgaatgcgctgcgtggcaagacaacggccgtggttgtgccctctgtcgctgaagatgtggccgacgatgtcggaacaaccggaggagttgtggcagtggccgatgccggcgcaggtgtggtggtgaccatgaccagtccgacggtgacagtgagcggcggcggagaagccgtcactcccggcggaggctccgaacggccggagaagctgcgcgccaaggagctgttggtcaacaagctgtacgagtgcaagctct

SEQ ID NO: 174 - DNA, 210 bp, Drosophila suzukii
accagcgattcctcgatcacgtctaccaggatcacctgggcggcgtgggtggtggcggagcgagcagcgacaatgcctccactacgggaagcggcatggctaggagcaacagcatggagcattcgccgggcaagaggagtctgctcggtgccctgggcattggcgttggctcctcggcggatgagtcgcgtagcagcagtgcggctccgc

SEQ ID NO: 175 - DNA, 250 bp, Drosophila suzukii
atgaagcctatgaactttgcctttcgggacatagatgttaatctaccttccgcagacacggaaaaccctcaaaccacggatccaaaaaagctgaagaagcagaagaggaagcccgaagaaacggaagaggaagaagcggccggcatacacacacaaccacaagggggtggcaagtccaacagtccgagacttgggttgggaaaagctcaaaacggcgccgttaacatggacaagatgacggttgcccaga

SEQ ID NO: 176 - DNA, 393 bp, Drosophila suzukii
ccatcaagcagcagaatcccgcctgctcgctggagaagatgcagttgatcgtccagaccatgtgggactccctggacgagacgcaaaagaccgtctacagtctgcggcatgagcaggagaagcgtgactatgtgcgtctgatgcgggactaccgtcatcagctgtccgaatcggaggccacgtcggagctggaaacagcaccaccagctgttgctcccccacagtcggtcgttgtgccgccgcccctggacacacccaaagtggaggctgtcgaggagccagcgcagcctgctccggagcaaatacaactcctgaccgaggcggccaccgtgcagaagtgcacccgggagcagtgcaacaagccggccatcatcaatccggactgggaggacg

SEQ ID NO: 177 - DNA, 250 bp, Drosophila suzukii
taacggcttttcgtggtggcgagtgctttcgaaatcaaaggcgaggtttttaatcgaatcaaattagtgaaaatttaataatcaacgggaaaagttaaaggaaatttaaaagaagacattttaactagagtaatatttgataaagagataaaatacattaaagtatatagaaatttgtcgtcaatattaaagtgtaaaagtgaataaattttaaaaacaatcttggaaattaggaggacaataagaaaac

SEQ ID NO: 178 - DNA, 232 bp, Drosophila suzukii
ggacactccgctcgatattcccgatgacataagcgccacgtcgccagtggccagtgataaggtgaaacccgcaccgcccactccgccggaagttgccaggcgtgcggaaatcaatttgcagccggagacaggagcatcctcggatgcgccgacgacgccgcaggaaactactggtggtgatccaataatcgaggcgggcgacgagcagccaggacatgcgcagcagcagcaa

SEQ ID NO: 179 - DNA, 300 bp, Drosophila suzukii
aacaaattagggacatcaagcccttgccgggtttcctgcaggccttcggctccaccgaaatcgggcgcttttccgagcgattcctgcagacgcccgagtcgctggtggaacgattggccgaggagtgcgcagccagtacgcccagcaatttcgcatctcacccagctggaggctacatcgatcccccggccacgcccacacccagccactatgcctacgaggagcagaaccaaggcggctatgccaggaatcgaatgcggggctacggttacgagatgccggactacatggcgtatgagc

SEQ ID NO: 180 - DNA, 219 bp, Drosophila suzukii
cgcatcaccatcaccaccatggacatccgcaccacccgcacccacatccccaccatgtacgcccctatcccgctggactccatacgctgcatgccgcagttgtgggtcgtcattttggagccatgcccacactgaaactgggtggagttggtggtgccgctggtggacccaccggtggtgctgccaccggcagcagtcgcccaaagaagcagttcatct

SEQ ID NO: 181 - DNA, 225 bp, Drosophila suzukii
agtccaattatgtgcagcacggtgatagcagcaactacaccaccaacggactgcccgaggaggcgactctcgacggcaagttaagtaaaatatttttgttaatatattttttaaaatataatatcttaaatatgaccaaactggacgacatcagtccgctgatattccttaaccgaacgaaggctgctctcaactgcgctgcaggatccatgcaggttgatctca

SEQ ID NO: 182 - DNA, 285 bp, Drosophila suzukii
agtacgacagcgatggtgggtcgagtgtgaggaccatccggaatgatcccagcatgggtggcatcctaatgcctggtggtggtgtgggaccaggcggcggacccggtggacccttcaatctccagcgatcgcgtcgcagctcgcgcacttcctatcagaccgatcacaacgacttccggtccatgtccgaggtgaccgtggactttggacgcccccagatggacgcccatcccgataatgtgagcgatgctagcagctactataggatgcagtactacgacgacg

SEQ ID NO: 183 - DNA, 225 bp, Drosophila suzukii
gcatagtcaacatattcctgcacgcctttgagtcggttcagcactcacagtcgcagctcttggaaaaagtgcgggagcgcatgtatgccctgcgacagacctggaacgaggtcttcccgccctccaagatgtacgccctggatgtgaaggtgaagcaactggataacaactggcctatcacagccaaacagccagctaaaaaaatccacgtcaatccggccattc

SEQ ID NO: 184 - DNA, 363 bp, Drosophila suzukii
agcatttagaggagcaggaacgtcagctaaaccaggccactgacgcgatgactggggctcccatgagcatgcctgccccgccagcagctgctattcgtccgcctatcatggatcccggccaggcaatgcgtaatcaacgagctcctggagcaatacccaatatgccagtggctccgcagtttgccaacaagccaaaggtaaatcctgtcaatccggcgctgttgaactcggtacgccagcgagatccacgactagcgcgccaaatgcagtcgcagtcctcacatcccgcagcgcctgcacgcaacgatccccgcctggaggccaagtccagctcctcacagaaatctagtcggtcgcgcagca

SEQ ID NO: 185 - DNA, 361 bp, Drosophila suzukii
agcagcagcagctccaccaaccagtcaccggtgaagcgatccggcaagcactcatctaaggagcagtcagaacgctatatccggaacggctcgccagcgggatcatcaaagcgcaagagcagctctccgagtagctcgccctctaagtcaaagcgcagcgcttcccacaaatcgtcctcatctacgttgcgcggaaaaatatcttcagggcgatcacgcagtcgatctccagtcttcatggacgttgatctccgcagcaagtcaccagaatccaaggcagcggctccctcgtctctacctcaggtggccgcctcttcagcagcagcatctaaagcagcaaatgatttagagaaacgtaaga

SEQ ID NO: 186 - DNA, 378 bp, Drosophila suzukii
acgctctctttggcagtgaagatgtggacctacgtcgtgagattccaactgttaagccaggagtaatcgttgtggaagacgactctatggataactgcgatgtcagcaagcccacgaagaaatctggctcgcctccaaagaaggcaacgttagaagaactccgtgccaagttggcgaattcagctagactccagaataagcaaggaaagtctgacaagggaaaggatcaggcagtctctcagcgccttaagcagctgaccgagttgaaagccaacgatgattcccaggaggcgcacgacgaaaagatgcgcacgattctcagccaggctcaggagatgttcgagaatcacagcatgaaccaggaacagtacaaggatc

SEQ ID NO: 187 - DNA, 233 bp, Drosophila suzukii
agggcaacgaaaatcattcctcgggctcgccgcgtagcgatggatcaccgcgatacgaggatcaaccagcgcctgccccagagaaacccccgaacaaaagggataagaccaagagggacgttaagcgtcgcaagcccagcaaatggggtgatcaagtggatccggttgctgcacagcgaagtgcttggcaaatacctcccaatgccaataatattaataacaacaacaataac

SEQ ID NO: 188 - DNA, 464 bp, Drosophila suzukii
tgaccatgaccaaggccattaattcccttgataatcccatggcagatgtggtgcgcagcatcacaatcgacggaggatctaaggagattcgcttctacaaccaggttgccatcatcttcatggatggcgatcaaccgcatgaaattggtttccagcagggtcagcgcgttatcctaatagaccacaatgaaccactgccgctttgcttcaacgatgactacaagccgttccagttggatggtcagcttcaccgcattcgcttcggtttcccatcccgcgaactctacatcgacgagcactggtatgagatctattttggtggtccgcccgtatccgtgcccattggaaacaaaatgcatgttatcaaggcagagggtccaccgccaaacgtggacattggccgagtgcgacgagatttggtcgtgggcaagatcaacatgattgtggatgcgcatactatagtg

SEQ ID NO: 189 - DNA, 411 bp, Drosophila suzukii
gacagcagaccttccagctgggagccgaacagcattcgctgcagtttgtggacagtttccaatacgccttgctcgatgggcagctgcagaagatcgaatacggtggtcttccgaagggaatgactttaaatggcggtcgcaactgcttcattcgttttggcacgcttcccaagggagtcattgcgggcaagacacatgtggcagatatggtgtatattaagactgaagctccggcagagccacccaagccgccgccaatgattgttcggccaccgcccgtggtggagcaaccaaaacctgctccagcagctgccgctgctcctatttccctgccagcagccgccgctgcgctggagagcttgaacatcaatgacttgttccaaaagcttgtttcgtctggaataattggtg

SEQ ID NO: 190 - DNA, 294 bp, Drosophila suzukii
ggtgcacggaaacggggaaagtgctggacaaatctgatgtgctatcgcatcgcgaggaacccgaaacgggcaaaaagaggcgctcccatgtcatcgccatctgcctgtcctcggatatgaagtacctggccctggccgagggtggtcccaacatccaaatcttgtgtccacagacgatgaagcatgtgaagactctcaaaggacaccgggacagtgtggcaggtctggtgtttcgtaagggaacacatgatttatactcggcagccaaagatcggtcggtgaaaatctggtccc

SEQ ID NO: 191 - DNA, 309 bp, Drosophila suzukii
tggcctatgtggagagtttgttcggtcaccaaacgggagtgaccagcatagacgccctcagtcgagagcgggccatcaccgctggcggatcagattgctctttgcgcatctggaagatcacggaggagtcacagcttatctacaacgggcacaaagagagcattgagtgtgtgaaatatatcaacgatgagcactttgtatccggtggaatggatggagctatcggcttatggagtgccttgaagaagaagcctatttgcacgacacaattggcgcacggagtgggagataatggcgtggccaactgga

SEQ ID NO: 192 - DNA, 800 bp, Drosophila suzukii
ccaaatttaagatccgttgctccaggtttctctatacccttgtagtgcaggataaagaaaaagctgacaaaataaaacagtctcttccaccaggacttcaagtaaaggaagtcaagtagacaaccacacaaaacaccatttgtacgtcaaagaaataaattggttcgctgatatttgtttttaataaataaaactaactaatgtcaccaatgtaaagtttataaatgtttaactataacttacagatctgttcaaattaaaatcaacgatagtgaagtcggatgataatttaattcgagcgacaaattgacggttattaattcttttattaattcaacaagcaaaattaattaaatcatccaatcattttcattcaaaaaatacttgcagtgccgaactttagtgctggcacttagcatcttgaacttcaagggcttttttctacctctttaaatgtgttagaaaattcaacaaactttttgtatgaaggggtttttaacaatcaaattaattttgtttcattgaaatatctctttaaaactacattattaaaatttttaaaccaaaaaaaaacagattttgccgaacgagtcttggcacacttgtgttattaataactatttcgttgaaacttaaccgatttggttgcttaatttttgacaaaatccgctttgtctctgtgttttaggtgatataatgctaaattagtgtcataaaatcgttttagtacttttaattacacgagaaatggttatacagtggcggacaaaagtatacgaacgacccccttttttggagtt

SEQ ID NO: 193 - DNA, 250 bp, Drosophila suzukii
actatttcgttgcaatttttattagcctccaaggggaataaaggaattcagtgcaaatggtaagcgtggcggcggagacaaagaaaggaacacctgtccgattggaaaagcagccgacggccattttttgctagctaagacgtgactgttggccagaaagccgagcaagtgcagcgcacattcataaacccatcagtcaaacccacatcctggtcacatacacgcacacaccgagagcgagatgtccgag

SEQ ID NO: 194 - DNA, 249 bp, Drosophila suzukii
tgagtgaacgcactgcctctagcagcagcattggccccaggaaatctctggccccccagagcagcaaggataaggaatcctctagcacttcgttggcagagggagcaccagtatcagctgtcggtggcaacggagccggttcgcatgcatcctccaagcgggcttcctttgtggagactggtttcctggagatcctgaagccacagttcacgccttcgcagcctctgcgttcgccctctttcaccatgc

SEQ ID NO: 195 - DNA, 269 bp, Drosophila suzukii
acgaacagctggtggagagcaaccacgaactggagctggatctgcgcgaggaactggacttggccaatggggccaagaaggaagttctgcgggagcgagatgcagccattgagacgatttatgatcgcgaccaaaccatcacaaagttcagggaactggtgcagaagctgaacgaccaactaactgatttgagggatcgcaattccagcaacgaaaaggagtcactacaggatcccagcttgaaactggccaccgaaaccatcgactac

SEQ ID NO: 196 - DNA, 264 bp, Drosophila suzukii
tgttcgccgaatccaaggcatacacgcgagccatcgacgttcagttgcgccagattgagctcagtcaggccaacgaacatgtccagatgttgaccgccttcatgcctgaatcatttatgagccgtggcggcgaccacgactccatcctggtggtcctgctcatttcacgcattgtgttcaagtgcggcattgtcgtttcgcaaacgagggagcgcttcccagccgtggaggcgatcaccagggaagcggtgacccaaggccatg

SEQ ID NO: 197 - DNA, 243 bp, Drosophila suzukii
ccatcgagagcgacaatgcggcagagcatacgctgccccaggaaaagtactgggccctgctgtctgcagcgtgcgaacgcatctacgagcaggatgaccgtggaccaacgcaaaactttaagacattgctggcccaagctaactccgacctgcagcacattgcccaacatctgctggacaaggagtacgagataatctcggcagccaacaatgccggtggtcaacagaaatcgggtgcccaca

SEQ ID NO: 198 - DNA, 1129 bp, Drosophila suzukii
tttttacctgcttatatctttgtagatatcttatgataaacacaacgcgaaaaaggaactataatgttctttgagaaggataatattgtctttgataaagatgaaaacgagacgggtattcttgactttgatatttatgaaaatgagcgccagggcaagaggtatccatatcccttctttctggaagacaagtggaatagcactgatgatgacttctcgacgtcctgcccagcacccacacatattacccatcagccagagggcgcccacaccagagccagcaccacacaaaccacctctgccgaagaccttgcaaccccgatctgcgccgagcccatcatctgcgatagtagtagtggagacggggacgacgtcgtggccatccaaaaccctataatctccaagctcaaggaatctgcttcggcctccatagctcatacgcattctcgcaagcgcagacgactggaacgtcattcgactaatgctccaagtaccccggaaatcattaagcaattcttgccttttgagatgttcagggctgcctgcacaagtagcgacaccaaccaaatagaactcgaagaggatagaagcgtcatctcttcagtctcagcttcaaccacatgcgtcaccaccaaggagtcccggaacgccgaggtgtccagtgatgccgatcccagctttggggaaatagaattcctaaatatagaccagttcgtgaacacagacacaagtaatagcacctccaacacctccatcatcgaagcgaaaaatgcagacattgtagaggaagatagtagtgccgaagaggagaacagaaccgaatcagccagctcctactgtggggagtccaacagcgagacaagattcagcgatctcctctctggtcacgcctcgcccgttcaccctgtggctagtacctcgcagattatctcctcgcatgccggtgaaaataatgtcactcggaaacgaggacgccctgccaaggaccatgccgacggacccgatcccaaacgtatgttgcgcatgaataaaaggcaaaggaaggcctacgaggacaggatcaaaaacaacgaggcaagccgcctctcgcgtcgaaaaaagaagaaaagcgaggaggaggagaaaaaaa

SEQ ID NO: 199 - DNA, 268 bp, Drosophila suzukii
ggaggaggagaaaaaaaccgaggaggacctggcggccgagaatctgcgactccgtgagttggccgataaagtggcgtgccaggaacgcaagctcaagaagttcctgtcgaatactttaagacgggctcccgttaaatagccgcaagaataatgatttttaaaccaggaagaaactaaactctttgtcaagaaaaagctggaagtatgcattgtgattctcctagccctagataacgttaatgatcaaaatatttagttcgcccatatt

SEQ ID NO: 200 - DNA, 235 bp, Drosophila suzukii
cgcagggagcaggagaagcggcgcaagaaggaccttccgtggtcgaagcggatcttcgacatagacgagcatacgctgtttggtcgtactgcctgggcttggtttcggatcgtgggcttctatctggtcctgtacagcataataatacttatagtggccttttggattggcatcttcatgctggcgatcatcgatccgcataaaccgcgctggttgaagggtccgccgggtctgt

SEQ ID NO: 201 - DNA, 202 bp, Drosophila suzukii
gggtctgtcgatggtgccctataattcctctgcgatctccttctacgagcacctaatgggcgaggtcatcccaatcgcagacggcatcgacgcatttttgaacaaacttaacgacgatgccattgagttcttcaacgagtgcaaccaggacgaaatgtggggctacgtatcgcggcagccgtgcgtcttcatcaagctgaac

SEQ ID NO: 202 - DNA, 447 bp, Drosophila suzukii
tcatcaagctgaacaaggtgattgggttccagccggaaacatacgacactcaggacgatctgcccaaggaggtgccctcgggccttgacgaaactctgaggaagtacggccccacgccgaagatctggatcacctgtgaggtgaccaagggaccccagccggagatagtgttctttccgggaccctactacgaggcctccgagaagatgacgggcgtgcagcgcgtggtggccgtccagatgaacaatatgcccaccaattccgaggtccacttcagctgcaaggtctgggcccgcaatattcccattgataataagttccagggcaagggtcaactcaagttcgccatgcacgtgcgagtggatactgccatggagagagctgatcctccagccgaaatgaacaccacagctgcctcagtggtcacttatcaagttgcacaattat

SEQ ID NO: 203 - DNA, 227 bp, Drosophila suzukii
agcagcagcagcatcttcatcttggctcttcctcaacagttggatcttcggagaccaagaccgaggagaccagatgcccgggcatcgataaaagtgaaaccgaaattgccgagtacacaagacatttcaacagtctgccttgggccttgctggcgattctcctgctggcagctctgaagctccatgtggccaatgcggagccgagtggggagcagaaggaggaggag

SEQ ID NO: 204 - DNA, 241 bp, Drosophila suzukii
cagaaggaggaggaggtggacagttccagcacggagagcaatgagatcattccccgggaggccattcaaaagttggactactccgtgaggcaggctctacttcgggccattgataaactggagcaggaggaggcagctgccacggaaagtggcgaggagaatcttagtagcagtggatcccggtctgtcctccaagtagagacctccaccctgccttcgcatcgcgaaaaggatgagattc

SEQ ID NO: 205 - DNA, 219 bp, Drosophila suzukii
agacctacgagaagaccgtgtcgctcggccaccgcctggacattgtgttccacctaatccgcttgggactgttctacctggaccacgatctcatcacgcgcaacatcgacaaggcgaagtatctgatcgaggagggcggcgactgggaccgacgcaaccggctcaaggtctaccagggcgtctactcggtggcggtgcgcgacttcaaggcggcggcca

SEQ ID NO: 206 - DNA, 258 bp, Drosophila suzukii
ttgttagagcttgataagaattcagtgtgtcttctgtgtgtgtgcccgtcatcaagcaacaaatcgacgtatttttttcgaagttccaatggaaacccattcttaaacaaggagaacgactaaaatcgaaacacaaataaacccgaaacgaatcaaagaaactgttaaaaagtgtgcaattaaataataataaaagaaaaaacacaaaccagcattgtttttgcagagataaatttacattgtaaaggtctgtcaata

SEQ ID NO: 207 - DNA, 378 bp, Drosophila suzukii
tctttgttaccgcaccgcacgaggcaagtggcggcatcattggcgtgaatcgcaagggacaggtgctctcggtgaccgtcgacgaggaacagatcattccgtacatcaacaccgtcttgcagaatcccgatctggccctgcgcatggctgtgcgcaacaatctggccggtgccgaggatttgtttgtacgcaagttcaataagctcttcacagctggccagtatgccgaggccgcgaaggtggctgccctggctcccaaggccattctccggacaccacagacaattcagcgtttccaacaggtccagacgccagcgggttccacgactccgccacttctgcaatactttggcatccttctcgaccagggcaagctga

SEQ ID NO: 208 - DNA, 201 bp, Drosophila suzukii
ttattgtttgtgatcgtttcgatttcgtgcacgacctggtgctctacctgtatcgtaacaacctgcagaagtacatcgagatctatgtgcagaaggtcaatccttcccgcttgcccgtggtggtgggcggtctgctcgatgtcgactgcagtgaggatataatcaaaaatctaattctcgttgtcaagggacaattctcaa

SEQ ID NO: 209 - DNA, 219 bp, Drosophila suzukii
agcaggctccaccacatcctccacaaccgcaaatcgacaacgagttcttcctgcccttggagaatatacaaccggaaccctactaccaaaatcaaccgagctattaccagcgttctagtaactccctggacaggagattactcttgcagcagtcccagggaaatggttaccagcctcataaatcccgctcggcgcaacgtggtcccaagccaccaggag

SEQ ID NO: 210 - DNA, 228 bp, Drosophila suzukii
acaagaccaactcaatgccacatcattatcagaacaggcgatctggcgaggatctgcccaacaagtacgaggagtatgtggcggagaagagggagcagcaccaacaggcacctcctccagtttatccggaacgcaaaatgagctccacacgtgcagtggcaccacctgtttacttcccccgcaaaaagccggccaacttggaggaggctatcaacgaactggaggcca

SEQ ID NO: 211 - DNA, 219 bp, Drosophila suzukii
aggatgaactgcagcagattgaagccgtttccgaggcagccaaacgctgtggccagatgctgttggaaactctgcccgatgcgggagaggaggatcaggaacctcaggacaaacctctaaggaagctacacaaggagggcaaactcatccgggccatcgacgaggtctccgaggcggcaaatgccgtgtgcgagaagattctcaaggacattgtgacca

SEQ ID NO: 212 - DNA, 215 bp, Drosophila suzukii
atagtatctgtaattgaagaattgaagcttaacgaaactgtcagtctgagccaagatgtttacaatctgaccactgagacccttcaaagaatctctccagatgaggtagacggcttaagatttgctgtaatcgaagttagcgatagtttactcaatgaatcttccctcgatgaaatgcattttaaacttgacgaatcggaactggacgaatcgga

SEQ ID NO: 213 - DNA, 291 bp, Drosophila suzukii
aactggacgaatcggaaataattgatagaatgcttgaagcttcttttgatgagttagatgaattagggcttgaggaaaaccaactgaatgaaagtctacttgacgaagaaaatcttaacgaaagtcgtttcaacgacacctcttataatgagctggatagcatagatcttgacgccacagaacttaacgcaacaggacttaacgaaatttcgtacgatcagttggaggaactagaactcgacgaaagcgattcggtgatgccgttcacacgtcgcaagagcatcgtttacg

SEQ ID NO: 214 - DNA, 210 bp, Drosophila suzukii
gttcccccaccaccaccaccacgagcggtacgcagttgagcgcctttgtccagccgccgatgacgtcatcgccgccgccgatcaccagtttgcagaatgataataataacaatagcagtcataatattgatgcgggctttgaaagcgatagcatttcggtgacgggatcgccgcggaaaagcttgggctcacctttgacccacgacgagg

SEQ ID NO: 215 - DNA, 219 bp, Drosophila suzukii
taacccacaatccgccggatgcggagaatgccaatccgaatgcctcaccgccggtcagttcgacgcggcgatccccgtcgccggtggagaccatcgatctggatgacgtcagcaccacctcgcggtcggccagtgggtccagcggtcacgggggcggaggtggagggggcggacccatcaggacgcgaaccccaaaaccatcggcggatgtctggcgtc

SEQ ID NO: 216 - DNA, 225 bp, Drosophila suzukii
agattgtgattggtccgggcacgggctacgatcggggattgggaacgggatcggtatcggtatcgggatcaggagtatccatggcagcggcggaggccggagcacgaggtggccagcgtagtggcctgctgggcgccacgaggggcggcggtgggagcagctccgtcagctccacagaggcggcctactgggatgagccggccacgagttcctcctcatcggcgg

SEQ ID NO: 217 - DNA, 234 bp, Drosophila suzukii
gaataaagaagacggtgcgcttcgatgcccatgacgaggaggcctccatactggcagccactgcctcactgccaccggtcacaggaatcctgccctccacggccgtggatgtgggtgcggccaccatactgagcagtggcaagagcctggaggcaggcggaatgggagttccggttggaggcgattggtcgcgctgggaggccgagaggcagggcagccaggactcggccacca

SEQ ID NO: 218 - DNA, 261 bp, Drosophila suzukii
agtgtgtggatcagcactttttgggcgggatgacgggaccgcaaatgaatctgggcgtggtgcccacctaccatgtgcacaccccaaccccaaatgcccatcgtcgggccaggggtcaaatggccacgcctgcaccaccgcccactcaatcggtgctccgcctgtcgcgacagctgagtgaagacgccttggtggccgccgtacccatttcagaggccaaggcgcaacccacttcaatcctaaagaaaccgaagctggagc

SEQ ID NO: 219 - DNA, 237 bp, Drosophila suzukii
acacgaagagctggggtcgccgacgcattcgctacgaagacgaggtgatgccctcgtccgcagactatccctatccgcatcccaatccctatgccaaccactcaccaaccacggcggccatgtcgcgtcgctatggttcggagaccaatatccggcagtcgtacatgggggccaatgtggatgccaacaatccgttgagtcactcgcatttcctggtcacggatgacaagatagtga

SEQ ID NO: 220 - DNA, 298 bp, Drosophila suzukii
gcgccgccttggatgatgccaccagcatcaagaaccggtgcagccatcttaaaagtggctttgcttttccacagcgtctggcggaaccagccgaaacagtcgcccccgcccccggccccgccccttcacagctgcccgccggcaaccaggatgaggatgcggatatggacaacctcaaggccatgcccagtggcattcgcacccgatccggacgcactacccgcttaatagtgaccgccgcccaggagagcgggaaaaagaagactccttcggccgggaagatggaggcccacatcaa

SEQ ID NO: 221 - DNA, 336 bp, Drosophila suzukii
ccacgcccatggagagagctatggatcgttatgaggccaagttggaggcagacaaacaggcggctgaaggcaataagaaggcagaggagcagccaccaggtgtagtaaccacgacaagtacgggaactcaggcaagtaaggacgtgcctggaacatcaagatcgccagccaaacctgctgctcctgaaaccaccgaccaaacagccactgccaagccgacggtgaaggagtgcactgccccggatgccggctccaatcttctgaagggcctgccaaagtccctgattgataaaatccgagccaaacaggcggctaaagctttggaggcgatgactc

SEQ ID NO: 222 - DNA, 212 bp, Drosophila suzukii
ccgccaccaccgctgcccgtgaccagtgtcatcaaggtgaagcaggaaacggccaatctgttcgaggaactgtgccagagcgtgacgggagccacagcgagtccgatgaaccaccagtacctgcccatgctggcatcgccctgctccatggcctcgagtacttccacgctgagtcccctgtcttccatcgcctcaccgccaccaccgccgat

SEQ ID NO: 223 - DNA, 343 bp, Drosophila suzukii
cgcccagtccggccaccagttatgccgaatcaaccaccagttccattacggatttgacccggctggagaagatgaaggtgtcggacctgaagcagcatctaaagcgcaggaatttaccagtctcgggacccaagccgcatcttattgagcggctgaaaccgtatctcccgttggaggcactcgacagcaatgtggcaccaactcctgcctcccagagcagcaacaccaccaccgaagtgatcaccatcagcgatgccatggataccagcaactgcgggttggtggaccaacccgcaccagtgaccatgttggtctccgatgcgggcatggagcacgagcagat

SEQ ID NO: 224 - DNA, 393 bp, Drosophila suzukii
tggagcccattacaccgcttaccccgctgcccgagttatccatgtttaatggggccacgcccaccacggcggcgggtggagccagcatagtgccattggtacccaagctggaggcgcccgccacgcctgtccaaaacctcgacatggccatggacacgaatgaagcgcacgtgaacttcgccaccgctcagcccacgaatcatggtttcatcgagaacatagacatggactcgcccctgcaggcggatgcaagcgttatcgatgccgagagtgtggccaagaccttggacattttcctggaacagcaccatgccactcccccgccgagcacaccgcccaagagttgtcacagcggcagcgagaagcccaacagtccggatgccaagctcaatc

SEQ ID NO: 225 - DNA, 204 bp, Drosophila suzukii
gcggccccaatccctttgggcccgcatccagtggcgactttgtttacggcatggacggcctggatgccgccgatttggaggcggccggaatgccccagttcgccctctcgccggacacctacgatgtgcggcagcggaccatcgagaatatctgggacatcaccgtctcgctcaacatcctctataaggagaactggacaaaat

SEQ ID NO: 226 - DNA, 256 bp, Drosophila suzukii
gccacgcccgaaaaggatggggtggccggcggagctccgcctccgaatgctggaggaggatcggtaggtggcttgggggatatagattccctaagtgccagcgaatcgaggggctctatgcacggcttgagtatcttggcccccatccttctctgcttctcgatgatgatcatctatattgtcttcggcgccgccgtcttgtatcgcctggagaattggcccatcctagatggcatatacttctgcttcatgagcc

SEQ ID NO: 227 - DNA, 249 bp, Drosophila suzukii
catccgccctgtggtccgtggcggctcccacgctcgcgaatctgccgccaagtgcctccagtgcggttcccgctcccacttgtggttccctgagttcggcgcacctcatggccggcggtgcaggtggtgcacccagcaatagggccatttcacccggttctggcagtcatgataccttggaatcggctgacgaaaacaggcacatagactcggactacttggatgacgacgatgagcccaagttcaggc

SEQ ID NO: 228 - DNA, 215 bp, Drosophila suzukii
tttctgcacacacgagcaccagcagcaccacatcgatccagtcatcacccatcgagccagcttcctctctgcccacgctgcacaccacgcatacaccaccggcttccagcaaaaataacctttttgtgcgggtgtttcgacgcttttcaagtaactccatttccggtaagacgtcggttagccctaaaaacgaagtcgacgtaccgaaagtcaac

SEQ ID NO: 229 - DNA, 206 bp, Drosophila suzukii
caacgataacaacaacggcactctgaacaaagagcaaacgaccgatctagaggtgctttgctctcaagacaataggagcagggaacacaatgaggacaaaatggatggcaaaatacagcctgcagatgccaagagcaaccagaaagctggtgtagcttcgggcaatcctaaaaaagacaagtcggctaaggggacgtcgcaagcgg

SEQ ID NO: 230 - DNA, 372 bp, Drosophila suzukii
agtcctcctcggacacggtaatagaaccgttgatcaagcaacaggccccactgcattcgtccaagaccacgcccacgaccttgacggcaaacttcgtacagaacattcgattcgtgcgcaaaaatgtggagcagtcgggcaggaacacaaatccgctgcagttcgtcgagcttgagacggagtttccgcgcgactatgatgacaacattgagatgctgtcccgcgaggcggagcacttggaggagcagtttcgcacgcctacgcggtcgaatgcaacggatgccacttcccatcaagtggccggcattattgacaacattattaccgaagcgtcacgaagtcttacaatcgagaagactgaagacgatgtgc

SEQ ID NO: 231 - DNA, 405 bp, Drosophila suzukii
acgatgtgccattgaagtcctccaccaagcactcgagcggcgtcaagcgcgttggcttccaggtcgaggagaaggacgataccgaaagtcaaagcgaaaagcagccaaagagcatcgatgatacagccaagaagtcggagagcgccgaggttagcgcagaggaagttactgtcactggttcctccacggatgcttctgcatctctgctaccttccacgtcgacggtgtccaccacctcgtcagccacatccatcaccaagagcaaaagcgatgaggatgatgacccggtggctatgtccccgtgcggccgtttttttaagtacgacaaggaggttggacgcggatccttcaaaactgtctatcgtggtctggacacgttgacgggcgttccagttgcctggtgcg

SEQ ID NO: 232 - DNA, 213 bp, Drosophila suzukii
ttcccatgcaacagaagccaaccgtgcactacattcaaaccccgcagctggcctcgtatcaaaactcgaacacaacaatgcaggagatgggcaacaaccagcaacaacatgcagggttctcggccatacctccgcagcaaacacaatttgtgccacaacccacacagcaaccaatacagttgtcaatgcctttagagcagcaattgcagcagt

SEQ ID NO: 233 - DNA, 426 bp, Drosophila suzukii
aacaacagcaacaacctttggtccaacaacagcaacctttggtccagcatcagcagccaccccagccacagctgatccctggtgttcagcagcagcaactaccacagcagcaacctcaagcagaacaacacccacagatttcttcgcaaggccctgtgcaacacgaaaatgtgcagccaattcaagttaatcaggaactaggtgtcgcaacggaaaccatttctgttaatagtacccaagcaaaccctgaaggtgcacccaaaacagaaaatcagacatctgcagatgcggaaaagcagctgaaacaacaggccacgggaacacgttcccaaaaaccaagacgctctaacaggagcggcaacgaaaggattccgaagctaagtgttaccagtgtggacgagggcagtgtcataaactgtcacatgg

SEQ ID NO: 234 - DNA, 225 bp, Drosophila suzukii
ttactccaactggtccggaaccaccgctcgatgatgctaaggataagtcactgattgtgagccagaagccttgttcctttgctatcgctagaatgcaaaagcttttggagtcgaccggtggtggtgctccccgtagcctaaatctgcctttgaatcgtcacctaaagattcaagaggacctaaagcatactagaagccttgacgacttgaccgcagtgaaaataa

SEQ ID NO: 235 - DNA, 351 bp, Drosophila suzukii
cctttgacatgcccaacaaaaccgctttggaacctttggagaacgcgcagcaagcttcggcagttgaagctgagaagccaaaagataaatccgcacaggcattgggaaaccaaggaaccggagcagccaacactctggagcagctaaagatagaactagagaacataactcatgcccacgcctttgcctccgcggtggtggcctcgatcaataacagagccccccaccaagcttccccagcaccagccatgtcctcactgaagacttcatctggacaaccacaagcacaggaggtaaacaaggcgaataacggagcaggggcatcagcaccttcagtgggtcagaatactc

SEQ ID NO: 236 - DNA, 264 bp, Drosophila suzukii
ttaacggaattcagttgatataccaacagccccagcaaatccaccagttgcctggaggaacctccacttctacaagcggagcaggtgctcagtgcatagtcgtgcctcaagttattaatcagaatggcacccacatgcaacaaatgtctaatcttcagccacagcagcaacttgtgcatccgaacataccacaacagccgcagcagactccacttaacggccatcagcccatggttaacactcaccagcagcagccacaacagc

SEQ ID NO: 237 - DNA, 226 bp, Drosophila suzukii
tcgacgagttcccgcacctgtcgccgcacaatcaggttcacgggcaggcggtcaacctgccggagggcagtgcccctccccatccgcctcccccaacgtcggtggcgaacagcacctcgccctgcagttccgcctcgcccacatccgcctccgtcctatccgccgcatccgccacgacctcgaatcattccctggcctcggggatgatggatcaacgggccagatc

SEQ ID NO: 238 - DNA, 237 bp, Drosophila suzukii
gaaagacggcgggtcaaatcctaaatggaatccatcgcgaggtggaggtgcagtcggtcaactccatcatcagcacttaccacgatgtcctgctggacaatgaagactatctgaatcccattcacaaggatgtggtggtcacggaaagtgtcctgcggcagcagcacggcaacttgggcggcggcagcaacaaccatttgggcggcagtggccacatgggcagtggcagtggcagct

SEQ ID NO: 239 - DNA, 1001 bp, Drosophila suzukii
aataattaaattattccatcaaatggagctctgtgcaatttggatataaagccatatcgtcgggatgtgtttattccgataataggacaaacaattcggcttgtttgcgatcatatcgatcataccattgtatgtatgtatgtacatcaatatacatatgagtatgaaagacattgttcaacaggtcgaaaacatatgtaaataaagacatgtaatgtgcattagacgaaatcaaagtagtgcgattacgtacatatatggcgaagaagaattgctgaggaacgcaagactacattgggcatttcttagaaattgatatttgtatgtcaagaaagggttcccccaatatatgtacttacgatcgcctccgattgtacgcagtattcgatatcagagttccccaaaaattcttgataattcggcactcataaatggcttaagggtgcccccagactcaacaatggatcttttatgttcggaaaacctagttggtgaatctgattcatcattgtatcgcctaaacaaatgccaagagaaaatgtctgcgccatatccaacatcgtcaatgggtgctataaaaccccatacggatccagagccggtgcaaagtccttcggaatattctcagaacaaccagatggacgagaagattatgtacatatatgcatcggtagacgcggctgggaagaatcaagaagaattggagccagaagtaccagtagcagcaccaccaacgcaatcatctctacaaagttatgcgcattacatcagccaggaaccgaagtcactgaccacgtcgcaaacacaatcacaatcacagtcccagcgttataatgatcgggtgcccaaaactgccgattcacccgccacggacaacgtgaacaccgccatcggggatcccacactgtactcggatcggtgcctggagaatgccctcaaggccgaggagaagtaccaccaaattgtggacacttacttcactatccagaaggatattacgc

SEQ ID NO: 240 - DNA, 321 bp, Drosophila suzukii
ttaaatgggagctgtatgtactcagccgtttgggttgggacctttcatctgtgactcccctggatttccttgagcttttaatgatgcgcttgccgatcggaagtaaaaacttcccagacataaacattggaaaagttaggggacatgctcaggcattcatatctctggcagcaaaagagcataaatttgccaagttttcggccagcacaatagccgcatccagcatagctgcatcgatgaatggcttgaaatggcatttgaggtcgggacacaacttacacttcctgttgagtcttatgactgatctaaccagcgtggagc

SEQ ID NO: 241 - DNA, 326 bp, Drosophila suzukii
gtggagcaagctcaggtgcaggattgcatgttgcatatggaggacatcttcaaagagcacagtcgaaacctgcagccctttctagtgaacatagacccctcgcagatgtccacgctgtactaccagggacgttttcagatacatcaagcccagcacctctcgcaaatctcattacgatccttgcctctgccgaaaacatcagccgactgtgtggaacagcatcagcagcacaacttcggctcggcagcgcctcaccgaacacatacatgcaaaatgcaggcgcaggcccaaaatgagctacaagacattacattttgaggtgtcaa

SEQ ID NO: 242 - DNA, 288 bp, Drosophila suzukii
acattttgaggtgtcaaatagtaatacaagcagatagttatgctagatttaaaactaaaatatataatataccatttttactactgtataggatcacgattactttatattcctatgactgtaagattggtcaatatcatattaattacgtctgtaccgatgtatttcattaacccaactattgcgaccaatttatgggtttttaatttagctatcattaataaattgtataaaatagcgttagacaatcatcatgaaactttaaaatggaaaaaacattaaaacgag

SEQ ID NO: 243 - DNA, 326 bp, Drosophila suzukii
atgccgtcggcggaggcggtggccagcaggagtcccaggtacttgggcgcgaactccacatccgtgacgctggtccgcgaatcgaccagggtggtgcggcgcacccatcgccgggatggggtattgctggcagagatcttatcgccaatcacctcctcccaaacggaggcggtgcgatcgaacgagcaggtggctaccacctggccgaactccggatgcgcccaggacacgcgccaaatggagccggagtgggccttccagctgctggtgacgctccacttgccctgcccgtcctcatcccagatctgcactctggctgcttttct

SEQ ID NO: 244 - DNA, 267 bp, Drosophila suzukii
caaatgagtccaatgacaccgccgcccagtccgcggagggcgagaggcccagctttctggtgggcgacgagatcgatgagaaggctgccgaggcgggcgaggcctgcgacgagttcccccagaagatgcagaacgatattcggcagaacggcgatatttccgagcgacgcaagcggttgaggccgagcatgtcgcgaggcactggcctgggccaggatcgccatcaggaccgtgacttccacatcgccaccaccgaggagttcgtga

SEQ ID NO: 245 - DNA, 318 bp, Drosophila suzukii
ttgtgcgtcgaccaggagcggttctggatgcaggatcgctgctgggacatttggagctggacgatccgtcgctcgtaacgaaggcgcagcctttcaagggacagttccaccagccggagaatgcaccggttccggagaagctgaacagggtgcacaatacctacaagagcatcctggagaatacactggctggctattgtctgcccgaaccattcaatgcgcagagactgagggacatcatcgagaagttcatgcagagtttgcgcgatccctcgttgccgctgctggagttgcaagaggttatcgcctccatctctg

SEQ ID NO: 246 - DNA, 252 bp, Drosophila suzukii
ttgtgcagctggtgcagcgttaccggaatggaatccgtggcaggatgaaggccgccgtgcatgagctactgcgtcagtactatgacgttgagtcgcagttccagcacggacattacgacaagtgcgtgggattggtacgggagcaccacaaggacgacatgctgacggtggtgaacaccatcttctcccactctcaagtggccaagaagaatttgctggtcaccctgctcatcgatcacctgtgggccaacg

SEQ ID NO: 247 - DNA, 327 bp, Drosophila suzukii
ccaacgaacctggactaactgacgaattggcaaacactctaagtgagctgacctccctgaaccgagcggagcattcgagggtggcactgcgatcccgccaagtgctgatcgccgcccaccagcccgcctatgaactgcgtcacaatcaaatggagtcgatcttcttgtcggccgttgatatgtacggccatgacttccaccctgagaacctgcagcgtctgattttgtcggagacctcgatcttcgacatcctgcacgactttttctaccactccaaccgcgccgtgtgcaatgccgctctggaggtttatgtgaggagagcttaca

SEQ ID NO: 248 - DNA, 243 bp, Drosophila suzukii
atgtgaggagagcttacacctcctatgagctgacctgcctgcagcatttggagctgtccggtggtctaccgcttgttcatttccagttcctcctacccaccgcccatccgaacaggctgttctctcgtatgtcctctcccgatggactagatcaggcagctgccgagtccttgggaagctcgtttgtgcgcaccggtgcgatagcggctttcgactccttcgagcactttgagatgtactcgg

SEQ ID NO: 249 - DNA, 248 bp, Drosophila suzukii
ggtggcttggcgcattgtcctggccactcccgagtatccgaatggccgtgagatcattgtaatagccaacgaccttacctacctaattggttccttcggcatcaaggaggacgtcctgtttgccaaggcttcccagttggcccgccaacgcaaagtacccaggatatacatttccgtaaacagcggtgcccgcatcggacttgctgaggaggtaaaggcaatgttcaaaatcgcatgggaggatccag

SEQ ID NO: 250 - DNA, 267 bp, Drosophila suzukii
cctacgaggagattgttaccatcgccatggtcacctgccgcaccatcggcattggttcctatgtggtgcgtctgggccagcgcgtcatccagatcgacaactcgcacattatactcacgggctatgctgcgctgaataagcttcttggacgcaaggtatacgcctccaacaaccaactgggaggcacccagattatgttcaacaacggtgtcacccacaagactgaggccattgacctggatggtgtgtacaccatcctcgactggc

SEQ ID NO: 251 - DNA, 228 bp, Drosophila suzukii
tcatgcccaccaagtcgccgtacgacccgcgctggatgctcggtggtcgtgtgaatcccgtgaatgccaatgactgggagaacggcttctttgaccgcgactcctggagcgaaattatggcgccttgggccaagactgtagtcaccggtcgcgcccgactgggtggtgtccctgtgggcgttattgctgttgagacacgcaccgtggaggtggagatgcccgccgatc

SEQ ID NO: 252 - DNA, 207 bp, Drosophila suzukii
agccggagggcattgtggagataaagtacaaagagaaagacctggtcaagacgatacatcgcctggatcccaccaccattgggctgaaaaaggagcttgatgatgcaaatgcatctggcgacaaggtcaaggctgctcaagtggacgagaagatcaaggctcgcattgctttgctcatgcacgtttatcacacggtagcagttcact

SEQ ID NO: 253 - DNA, 432 bp, Drosophila suzukii
atgctggtgacccagacgggagcccgatggctgcgcagggcggaagatttgggggaggaggtcgcccggcggtgccgcccctttctgccctcggtggcccgcttctgcctggtggccaccttcttcgaggacgccctgcgcatgtggttccagtgggtggaacagctggctttcctccaggaccaccaccagtgctcagacggccttgcggtggcaatagtcctgctgaatctggtgggtcagctggtgggctcggctctggtcatcctgcacctgttcaccacaaacgcctggtggttcgacgatggagattctagggatctgctgaagtacaacttctttcacaccttatcggtggtaggaggtcttctgatggttgtggttcttggacctggggaagtatccctcgagcaatataaaaaacagtggtag

SEQ ID NO: 254 - DNA, 299 bp, Drosophila suzukii
ttcaacaatttcgaatcagtcgtcgtactgcgactatcagactctgtcctcgggattactgctcccggaacaggacaatcctgccagcacttctaagccacacctgcagtcctcagctgccaccaccacgtcacctgcctacagcaccaaaaagccggatagccatgggacggaactgaggagcaccaagtcgtttagcagtgtggatgataccaaaaagaagaagagcgccagcaatgagcccgttgaggtgttcctgggcggatcctgtaatccaaccacctggcgagccgacgttg

SEQ ID NO: 255 - DNA, 398 bp, Drosophila suzukii
tcctgctaaatgtggagtccatcgagacaaccgagataatcaccaccaaaactatagagaccaagacgaatccgttgactacatcagttgttgtgcctgccgaagaggaggagagtgattccaatgactcggtcttctccagtaacagttcaatagctagtgccggcgatgccctctgttgtggtggtggtttggatatccgggatgtctatttgggcggaagttgtgtcctccgcaccaagtggcgtcaagagctggctgtcccctatctacagtccaagagtgttagtttccacaccccagcgctgcatgagagtatccagcagatgattcaaaaccaggatcagactggtgcttctcagcagcaaacagcgccaccgcaagagcaacagcagcag

SEQ ID NO: 256 - DNA, 360 bp, Drosophila suzukii
atcagtacgatgagtttggccgcgtgaccggtatgatcctgcccagcggcgagatcgttaggatcacctcccagctagccgatagccagggactcaccgtctatgtccacgcctccgtggagtcgctgttctcgcgggagagaattgccggcgaggccaatgaactgctggtcctcggaggagtgagatccaccttcctgaagcgcggacaggcccatgcggatgcggaactcaaggcgaacaacacactggtgatccatggagacaatggcgtggtggtggaggcctcggcggtggccaggcatcccctcttagaggccgctctgcccgtggaggccgagatgctggccatgtggtcac

SEQ ID NO: 257 - DNA, 201 bp, Drosophila suzukii
atgtcacccagttcttctataccaatcagcagcgaccttacgaggtcagccagatctactcgcccagggatggaaaactaatgtcgctgacctacgatgatgtgggtcacctgatctacgcccaggtgtaccggcacaagtactacgtggccacggaccagagtggcactcctttgatgcttttcaaccagtatggcgagg

SEQ ID NO: 258 - DNA, 258 bp, Drosophila suzukii
ttgtctacgattcgaatccctatttgtatctgcccattgacttctgtggaggcatcctggaccaggtgaccactctggtgcacatgggcgatggccgggtatatgacccactgattggccaatggatgtcccccgattggcaaagggtggcggagaggatcattactcccacgagactgcatctgtaccgcttcaatggcaatgatcccattaatgtgggtcacgagcgtcactatcccgaggactttgccgcctgga

SEQ ID NO: 259 - DNA, 468 bp, Drosophila suzukii
atgtgggcaatctggtgcctcagctggccagggatttgtggcaaccgccggcgctgtggggtcgtcccccggccaatccggtggccctcaatctgcgccgacccttcgacaatatacccaccatggcggtagagagcggcttcctggcccatttgaatgtacgccgaatgtcagactttgagcagctgtcggcgccaccaagatcggccctcaaatgcgatgtgatggacccctcgccgaagaccattggatcggatacggagccacctttcggcaagggcatcgtggtgtcccgcactgccgatggccaggctattgtgtccagtgtcccagctgccaatgccatttacagggatgtctacacgagtgtcttcaatcgctccaagctgctgcccttcacctttgtggtgcacaatgcccagcaagactcgttcttcttcgtcaaggaggatgcctggcgggccaccg

SEQ ID NO: 260 - DNA, 271 bp, Drosophila suzukii
acaaataaaaaatggaaggaaaaccctaaagtcggatacagggtgaagcaattccacagaaggggcaaattcgcagaatacttgaagggctggaggagatccactagagaatcccagtgggaaggaacatgccgagtgggacttcgatctctacatggacatcctgccggtcgcgccctcgcaaagaaaggaacatcaaacaaaatgacgaactcaaagggctaccgccgtggcacacgtgatatgttctctcgtcccttccgaaagcatg

SEQ ID NO: 261 - DNA, 259 bp, Drosophila suzukii
aggtgctgcgcacccagtatatcaagctgtttggtttcgaagaccagatcctcgacgtgttcaagatggtgcccccagacgtgaaggtcatcttcgtctatcttctgcaataccagatggaccatctagccgaggagatgtcgagccccaacttcaccgtttcggctatttacggcgacatggagcagcgagatcctgaggtcatcatcaaacaattccgttcgagctcttctcgcgtcttgattaccactgatttact

SEQ ID NO: 262 - DNA, 247 bp, Drosophila suzukii
aatcattagttaaatttataaaacaaacgtcgcaggcgttttagttgttatttaaatttacacgggttgagaagttcctaaaaaaatcagggcaatgcgaattgagcaggaatttatagagcgaaggaaacgtgaatattatctgctagtattttgctaaagataagaaaccgaaaatcaattagctgttatcagtattactttttttagtcgcgtgtttctttgccaagatatttttagccagcgt

SEQ ID NO: 263 - DNA, 228 bp, Drosophila suzukii
cctacgagtgcattgtgcaggatctgcagcctggccaggattacctagtgcgtctgcaggtgcactacgagaagttgtcgggaaccgtcagcgatcccacggaatttcggacgccagcctgcgagcccgacccgccgccgcctcctaaactggtctcccgcaacaagagttccataaatctccgatggactgctccggccgctaatggggccagcatacagcactatc

SEQ ID NO: 264 - DNA, 213 bp, Drosophila suzukii
cggaggttagctaccgcaccctggcggaacgtcctggcagacccggcaagccgcatgcaaagggaaaaatccatggtactcagttcaaggctcgctgggatgcacccggcgatgctggtggtgccgagatccttcgctaccacttggagctaagtgccgcgggaccggccttcgagaggatctacagtggcgctgaaacagaagccatgtgcg

SEQ ID NO: 265 - DNA, 228 bp, Drosophila suzukii
aaaccggctacaagttccgcgtgcaagcggtgaacgccattggagccggagcctttagtgcctatgccaagctgaccacccagccggctcctccggcgccaccacgccttgagtgcagcggtgccgggcacaactacatcaagctgaagtggggcgagaatggagccaacggcaaggtggccaacaccaatccgtctggaaatggcggagactttaccaagtactttg

SEQ ID NO: 266 - DNA, 219 bp, Drosophila suzukii
tgccggcgaacataaagccaccgcgagtcgtccaggagggcagcgtttgcctgatggagctgcccggccaactgggcatgcagctcaccctggagtggcagcactcgaagaactccttccacgatcgcgtggagtacgagctgcagtacgctgttttgggcgccgcggagctggagggtgaatccctatcgcccaagggtcgcagcagcagttccagtg

SEQ ID NO: 267 - DNA, 386 bp, Drosophila suzukii
caaaaccgacaagctaaacatggctaaagcatcaacagccagcacacacaacaacaagagaagcaacaacaacaagcagcagtagcaacgcggccataaacaaaagtcaaaatcataaaatccttcggatatatatttggatattatcgccaataaacggataatcagcaacagaacgtgtggatatcaccaaaaaaaaaaagtagaaagaaaacgggaaaatccgaaggaaatatttataaaagccaaccgcctgcggtaggaatcttggaactaacacaaagaaggattcgataccacaatgcctccagtagcagtagctgttgctaaatccttggcccttggatcagctgaagccagtagattccaatgagaggagcctgggc

SEQ ID NO: 268 - DNA, 232 bp, Drosophila suzukii
cagcaacagcaacagcagcgtcggcggcatcgttggcagcggcggaccgggctccaatagccagggcagcagtggtggtggcggaggtcctgcaagcggtggcatgggcagcgttgaatacctgataacccgctgtgcgccccagaaccgggcgcaggaggtggcggccgctgtggctgttcaggcgttcctggctgcctcgcccctgggcgccatggaaagcggaaggtga

SEQ ID NO: 269 - DNA, 258 bp, Drosophila suzukii
tcatattgaccgagttcaaccgcggcatgaatatcacggatgagatcatgctcggccgcattccgtgggaacgtttgtttgaggcgcccagcttcttctatagatatcgccactttatagtcctgttggtcaactcgcagacggccgacgatcacctggagtggtgtggtctggtggaatcaaaggtgcgtctgctgataggtaaccttgagcggaatccccacattgctctggcccacgtcaatcccaagtgttttg

SEQ ID NO: 270 - DNA, 255 bp, Drosophila suzukii
catcggcacccttctgctctatgtggtttatcggtttggagtttgaacgttcggagaacctcaacgtagacctcaccgagagtatacagaactttacggagcacgtaatgatgcatggcgtaaacatcaaaatgctcaaagagggcatgaccattgatgctcgccatgtgaagcgcaagcagttgtcgctctatttagactcggacttcctcaagcgcgagcgcaagtccatggagagtcacaataattttaata

SEQ ID NO: 271 - DNA, 333 bp, Drosophila suzukii
gtcacaataattttaataatgcgctattggccaaccgcaagcgactgtccacggaactggcacaatcgcaagacccactgccgccaggtcaacagcaatcgagtggaaatcgcggacgggatagcggggcgaagattcacaggctcagcgaatcgctgacagaggataactcgaatgcctctagcgatatgggggcaggaacgcctactacgcccacagccgcgcaaatgagtgcgccgagcttcaagagctcgggcaaaaacggttccgaaatggacgtagtggagcaggagccgtcgcagccgcacaacaacggcagcaacaatggcagcg

SEQ ID NO: 272 - DNA, 694 bp, Drosophila suzukii
atgagaactctgatgctgctcattcttggggtgaccagttcctgggccgtggactacgaactgatgctcgaggatccggacatttttgcgccttgtacagatggtccacccgggtctatcaacgctcgtcaggcagtaaacttggacgattttgtgatcgaacatgaatctgatatactccacctctccggcaacgccacccttatctgggatgtgcggcccaccgatcggattgcagctagggttgatttgttgcacttcaaccgcggaacctgggagcccactatcttcagcatatccaaccaggacttttgccccatcatgtacgacaagaatcagtactggtacaagtactggacacaatacgtatccaatcagcacgaagtggcaaagaagtgtcttagagagccaggtaccgttttggaacacgagcccttcgatttaaggcttaaaattgaaaatgttcatggccctactcttcgaggacgtcataagatggtcataaagctacaggctttcgatgagaagaacattccacgtccaaattctatttgccttttgctgctgggaatctttgggggcattatcgagcagcagcaacaaaattgcagcatgaatggggctgtgaaccagctgaggagtcggttcgtgtgggccgcctttaatacttcgccactgtgggaggattttgtgg

SEQ ID NO: 273 - DNA, 242 bp, Drosophila suzukii
tgtcatccacgcctgctgccccactcgtggctgccaccagctcctccgcctcccagatggcgggatccaggataggcagccagttggctccacaccggcgcaaccacctcaatttgtatggcaatctacggcagcgtgaacccgcctacaactttttcactggcaacgaagccgccgagggcagcaccggggatctgccgcacagcaagaccaacaacaacattagcaacaataataataat

SEQ ID NO: 274 - DNA, 401 bp, Drosophila suzukii
taataataataacaataatgtcatcaagtcaaagtcaagacgaactgaactgccagcggttgctggcggagattcgcaatccgagagcgatgtgaacgattaccacgacaatggcgagggccacgatggactaaggcccgcacatcataacagcaacagcaatctggagttctacggcaatctgcagagcaccaagtcgatatttaacaggagcaatgccaccgcacagccatcgcatcggaattcaacgtggtccctgaattccctgaaccagcgacgacgctttaatgcctccatatacggcagcacctcggcgctgagtgacagtcgcctgctaagccgcagtgcctcaacctccggctctgcgtctgcctccagctcacccttttaccagggacgca

SEQ ID NO: 275 - DNA, 312 bp, Drosophila suzukii
accagggacgcaccacctttggcggcaattccgcgaacaatcgcatcttcagtcgcagcaatctgagctcctccgccgcatcctccacgttggccattaattctgccggaagttcaccggcgcatccgctgcagggttccctgaccggtggcattggatacggcatgaaagcggtggatatgcgaccttccgatggcggtaacgtttcggaaaccactgtggatcaaagtggcagcaagaagtccggctccggcctgtcgaacaccacgctgcgcatcctcaacctgctggacagctactccacgccattga

SEQ ID NO: 276 - DNA, 539 bp, Drosophila suzukii
caaacaagatgcgttcgcgactctcacatcagacgcgcaacaaagagccacgcgcggaactggacgaggcacccctgccgctggatctgccccagatcagtttcccagacatggccagtgctccaaagttcgacttggtcatcaaaccgactgtgccagttgtctcaaaaccagctcccgttgccccaatcatcagtaataagagcaatagcaacgtttatacgaactccaagcagctgcccaacttcctggccaatccgcagccaacggctcccattgtaaacttttcggccaatggaaacgttacggcagtcagtaaaccagcgggacgcacatttaacttctcggagcccatacctttgtcgaattcgcaacagaactgcgtcgccaaatcggatatcaggcgcaagtactccttcccggcaccagcttcactcgatgagctgcagcaagtgtcagtggagccacctaagaataccacgcagggattcggagagcagtttaaaaagtcatcaaaggagtgggagtgcgatgtgtgc

SEQ ID NO: 277 - DNA, 941 bp, Drosophila suzukii
tggcctgtgagacggccaaaccgggagcaactgcagctcatgctgctcccgtccaggcagcaccaatcacgacagctattgtgccactgggtggtggctttggagaccgctttaagaaatcctcgtcagcctgggagtgcgacgcctgtatgctgtccaacaaggcggaggccagcaagtgcattgcctgcgaaacaccgcgaaaaacagcgtcgccaaaggttaacaacttcccgctgatcgccaacaatctggcgtctagtggatccggttttggtatggcatttaagccaaaggccaacacgtgggagtgccagacgtgcctggtaatgaacaattctagcgccgccgagtgcgtcgcctgccagacgcccaatgcacaagcgaaaagcacaaggaacgaagccgcccggagtccatccgcgtcgtcatcttcctcctcatcatcgtcctctgggtcatcatccggttcatcctctggatcatccgctgcaacatcaggcggatcatcgccgggtatcatcagcattgcatcctcgagcgacagctctcagaatggctacagaccagcatcagcagccgaggcgcccaagcaggattctggattcaagcagctggtggcagcacaaaaggcagccagttgggactgcgatgcgtgcatggcccagaatgatatgtcacgagttaaatgcatctgctgcgagcaactgaagccgggagcagcgagctctgcccccacaacatccgcaaactcggcttcctccggcagcagcggctcggcgaactcgtccgccagttcggtgcctaaatttagctttggatttggagcggtgaaggaagttgtcaagatacccgtggaagtgaaaccggcaccgcccacagccactggtacatttagctttggattcccgacgaacaacactcagggtaaggatgtggcg

SEQ ID NO: 278 - DNA, 236 bp, Drosophila suzukii
aggatgtggcggacagcaaaaagacggaacccacgaagacctttgcgtttggcgttaacaaagtggaacagcccaagacggtgagctttaaggcggacgccaaggaaacccaagccacttccagcacggaaacaacagcttcaactgcagctccagccctccagtttgtattcaaggccccaactacggcgaccacggccagctcaatcactaccagcactaccaacagcagcagc

SEQ ID NO: 279 - DNA, 214 bp, Drosophila suzukii
tccagctccagcgccagcggcggccacctcagcacctgctccagcggtcaattttagctttgggagtcaggcaaaaccggcggccacttcaagtgctggaacgttcttctttggccagacaccagctgccccggcagcgatgccagccaacaccaacgtgagctccatctttggggcagcggtgagcaccacgaccagctccagttcgagttcc

SEQ ID NO: 280 - DNA, 280 bp, Drosophila suzukii
ttgcgcccacctcgaccccgcagctctttggcagctggggtgaaaagaaggcggagaccacgaccagcagcgcggccaaggcattcgcctttggatcgccagccggatcgggaacgacgaccacacccagctttggctggtccagcaatggagccgcggcgaagagcaacagcattgcgatcaccagtgcggcggtctcctcatcctcggcctccacgatggccacgccagtctttggcggcagttccatgtttggagccggcagcagcaccaccagcac

SEQ ID NO: 281 - DNA, 364 bp, Drosophila suzukii
ctggcgtctttgggaatccctcaagtgcaccatttaaatttggaagcaccaccaacgagccggcggccaaacctgcgttcaactttacaggctccacggcgagctcgactcctcaggcggccaccttcaacttcacggccaatccggcggccaccagtctttccggcggcgatgcgcagccgcgcatcttccaatttggtaatccgttggcggcggttgataaccaggccagtggagcgggaggagccaactcctccgccggcatgttcaattttagcgccgcggcgccgctgatgcagtcaacgccgaatgccaatgcaccgttccaatttagcgccggttccccagcgccagccaatatatt

SEQ ID NO: 282 - DNA, 229 bp, Drosophila suzukii
aattttttttgttttttttatcgaagtgtctgtgagagtgcttggacgagccgatgtcgcatcggcgttcaataaatctaagttgtatccccatgtcgcactttgttttccgccgagaactctccacgttggatttcaaattggctggggaacgcaaaattgtgcttagaagacgagatgtaatctggatgatttgtggagcttatacatatgatgggaatactgatga

SEQ ID NO: 283 - DNA, 259 bp, Drosophila suzukii
tgcccaagaactttggcctccccaatgcggaacgcactgcgggattgccctctcctccgaccacgagtcgcgaggcaatgaccacatcggtgaatgctgcgccaccagagccggtgaactcacctcagccagttcgtcgaaagtcgcagtccgaaatggttcgctctactgcccgcgcctctctgcgcaaggcggcctccacactctcctccaactcggcgccagaggctccagctgggacacctgctgctccggctgc

SEQ ID NO: 284 - DNA, 214 bp, Drosophila suzukii
cctgctgctccggctgctcccctggtccgcgagagatcgctggccaggcggatcaaggcaccggcctgcgatcgctgtccccactgcgaacgcaccttcaatccaaaggccttcgaccgccacgtggagtggtgcaaggagaaggccatcctgaacaacatcaagtccaccaatagccaggagaccagcaaggctaaggagcgcctggaggcca

SEQ ID NO: 285 - DNA, 529 bp, Drosophila suzukii
gaggccaggaagcagtacaagcctcccaatctgaagacgaagagatctctggcccgggacaagtactctggaaaccacgaggagctcctggaggcgggagagatcgcggcacccaagccaagtatgatgtccctttcgatgacctcgtccgttcacagtgacaacacccaaactcaagttgcaagaccccgaacctcggcaggatcaggaggaggtcgtggcaaagcgaactcatcggtcacccagaaccaggtgagcctgtaccatgaggaccccccatcctcaccacctccaagggaacgtgctttagtgcgaccctccaagcgatccaagccagaatcctgcagcgaaatcgacgattccatggagcgacttaggactggagatgcccaccagttggccaagctcgactgcgtggaggcgccagttcttcgaccagccggacgccgcaggagcggatgcaaagtggataaaatcgatgtgggtgatagggagatcagcctgccccatcttccccaagtaaccatga

SEQ ID NO: 286 - DNA, 722 bp, Drosophila suzukii
ttccccaagtaaccatgactttcgacgagctcaatgggttgatcaagcgcaaaggcggcaagcccatctgcaatgtggtgatggatgaccaggaaatcgctggtctggcctccaaacaccgctcctccaagtcgctggtgcaacaggcacgtcgtcgcatttgcaccacggagagtcccaatctggagttcagagcgttgcaacagggttctgtggtgtccaaggacgtccagtttgcatccctggactccagtttggtgcccctgcagcgaatgcaacgcaaggtgtactctggatccgaggaggattccccgagggcggagatccagatcaaactggaggccacaaccatgcgcacagtgcgccgacccacgaagagatcaggtcaggttgcccaaatgatcagcaactctgaacctatgcgagctttgcccatgccaggattaaggcagagtctggaggccattaatcagtccatggggcagacggttctcccaaaactagagctgggtaacaagagggaggagtacgaagcggcggagacagatgaacctgataactataccagtgatctggaggatgagtatgaagagagggaggaccctataatgcgagttgccaagctgatcgagcatgccaagtcgatgtccaagaagaatactgaatcgagggagaaaatacaaaatgaagaagaggagcacgaacgggaacaggagcagaag

SEQ ID NO: 287 - DNA, 248 bp, Drosophila suzukii
gccgccggaggaggaggtgaccgccaccaccacaactacaaacactaccatcagaacaccaaaaacacctacacccagtatagctatgaccacttctttgaccacgtcgacgattaagccagcgcagattgcccagaagaccacgccggcctccaatttccgacgcacttcatcgcttaggggtccccgtcgcacgcccatgctaaacagtcgccccctgttcgccactaactatcgccccaccattc

SEQ ID NO: 288 - DNA, 331 bp, Drosophila suzukii
ccagcaaggagcagaaggacaagagcaacacgctgagtaagcagaactcggccaagagcctgggacagagcacccccactcagttgcctccattgactccaacgacggtgccgaaatcgccaagtggtgtggtcaaggaggtggccagctatcctccggtggccactcccttgcgactggagcccattagtagtaagccagtgatgaacatgaatcctccagctcctctcacacccataaagctggagagcatctttggtcccagaagggaaacggcttttggctcgggaggaccagttacaacatcacttccaggcgactacatagatcc

SEQ ID NO: 289 - DNA, 270 bp, Drosophila suzukii
ggcagcagtcgaatgcctcgagggtcagcagccaggaggagaagcagagccgcctggtgttggagaagcgggcagccgccgaggagcaccagcagaagcgggagatcttcatcagcatcgagacggagaccaatgcccagggccgctcgcccatttcgcccgagtcattgcgccacatggtcggcaacgcccagacgcccatcgatgtgctgcacattgagaacggaaacgagccggagcacgccaggttcagcaagatcagcgacacgg

SEQ ID NO: 290 - DNA, 394 bp, Drosophila suzukii
atcccatgtcctcgtcgcacggttcccgtcgcggagcaagctccaagctaagctcggattcggcatatggaagtagcaactcaccctatagcttgtcgcgacagcgctccacggaacttcatacggggtcacctcgtggccagggactcctgcgtccgcatacggccagtgccaagctgtccggctgtatgatggatgcctccacgcaggcccaaaccgactatggaaccctaaaggctcgccagcggctctttgccccagactttgggaacaacaatggggcaggttccgagtcctgcagcagtggatccgaccactcctttgcggcgcagccgaatccgcaacagcagcaggagacctccaactacaactacaagcagcagcagcaacagga

SEQ ID NO: 291 - DNA, 263 bp, Drosophila suzukii
acaacgacaacaacaacagtgtatcgatgacacccaccacatctgagcactccctgatgagcaactcatccacgagcacaagtaaaaagatgtcgaatttctgctatgcatgtggctcaaagttcatcattaagagcgccaactattgcatggactgcggtgttaagcgggtgaaactaaatcctcgaaatcggaacacggaacactttaacccgggagaaactcgcccccaagacgaagacgactgcctggatcgatcttaa

SEQ ID NO: 292 - DNA, 555 bp, Drosophila suzukii
gatgacgctaacggttagtgtttgttgttcgctatcaagcccacacaccccccgcctcactctattaggaaacaaataaaaaaaattattaaaataatcacagcacgcctggcgaattgatattgattgcgcgcttttcctcaattggcaaacaattgaataacaaacaagtaaaaaagtcgccctccattaatggaggcccatctccccctgtgtttgttgtttgttgtttattgttgtgagaggagacgaagggaaacgcgaagagcgaagagagagggcacataaagcaaggcaattgacagcacgttacgtatacgcctcttacgccccgcattttgcatttgtttgccagtttgctgtgtgctcgagtgtgtgtaaaattattaacaaacaattaaataacagagaagaaacattgccaaacaatacaatggatgaccttaaaagctattaagccttaaatgaaaactagaaagtgaacataaacagtggcaagttataaaaagcaaacgaatgttataaacaaatattttccaaaggaaaacaaaacaa

SEQ ID NO: 293 - DNA, 1015 bp, Drosophila suzukii
aaaaaagtttttttttttagtgcctcaatatgtattagaaaatattctaggaggcgcatatcaaaataaataagaaatatttaacgtacaaaaaaagaacataaatctgcaaaatatacagaaagtgctttaacacgaaccatttatttatatagagtttaaggtcagcagaaaagccgtgaaaaatcaaataaataaaaatccagagcaaactgaaaagcttgcaaaaaatgaaaacgaagagccatgactttataaacataaacagacaaaaagaagagcagggaaacatatagggggtgtttttggtgttctacaaggcctacaaaaggagtttgaagtgagcaagaaatcaatattaaaataaataacaaagggaagtcaacagtttgctgtaagtacggggaaaagacagcactatcttaaatttgaaaaatgtgtataaaaaatgtatccgtattataatagaaaatcaaaagacataccaaacaatgcaatgaaaacaaaagagaaattgtaaattaaaagcaaagagttggcaggcagacaagacgaagagccaagtaatttatgtggggttgttttccccacaaactccacaaaacacctcaagttgcactgccgagaatggagtttcaagtgagcagaaaatcaataaaggacttcccttcactcgcttcctgacttgcagccgaaaaatgtagaggccccaaaagcacacccccaacaaacataatacaaagagctgaaaaagctgaacaaaggcggaagcgaatcaattgtttggcctgaaattttaacccgactgcagtgacacaatttttggtcgaaagccactcgaccataaagcaaatactgtcatccgcccggctcactcaatatatttttggtttccactcttgctttttttcggtctctgttctttcgcttttttttgctttttggttaagaacatttagcacagcaaactaaatttagccagcacgacgtcgacaacgatgagaacttacaaaat

SEQ ID NO: 294 - DNA, 219 bp, Drosophila suzukii
gcggactctatcctcagccggaggccacgttcgtcaaggaagtcacctaccgcagctccaacgtcaaggaacacggcgaggtgggcgccccatccgcgaatctgaacaacgccttccgcctgatcaaggaggttcagaagcgatttaagacccgcgaggcggaggaacgggagaaggaggacctcgtgaagcaggacacgctcattctgtcccagaaca

SEQ ID NO: 295 - DNA, 248 bp, Drosophila suzukii
cgacacgccgttccgtgagctgggcttccccggagccccattccgcagcaccgtaacgctgcagcccacctcgggatcgctggtcaatctcaccgagtggccgccatttgtcatcacgttggacgacgtggagctggtgcactttgagcgtgttcagttccatctgcgcaacttcgacatgattttcgtgttcaaggagtacaacaagaaggtggccatggtgaacgcaattcccatgaacatgctgg

SEQ ID NO: 296 - DNA, 232 bp, Drosophila suzukii
tgtttggcatagaatataaaaaattcgtatttgtgtgtgcacgaaacgccgtaaacaaacgccgtaaaagcggacaaaacaggcagtgcgaacgatttttgccaagggatcgggatccgctggaagggaaccgcatttcgccgtttcgcgttggaagggccaacagaaccggaggagttcccatattcgccactttttgttgttagggcgcttccaaggcgggcagcttccc

SEQ ID NO: 297 - DNA, 244 bp, Drosophila suzukii
tgtatataaacacacacaccctggaatctttagagattgtaatgcacactttgggtgcttaatagctcagatagagtgatactatatagatcagaaaccgatcacaagttatcatgttgtttatagaactcttaagttacatttacccccaaaatgatcactttatttaagctcttaaacagcccacaaagttgtggtgccacgaaatgtattatttcttacttaaaactctgatattattcag

SEQ ID NO: 298 - DNA, 581 bp, Drosophila suzukii
aagacaaaaaaaaaaggaaacgataagaaaacctgtagaaatcctctctaagacaaaaactcaaaaaacacatacacggatacatactaaagataatctagttaaatgaaaaaaaactcatacgtattacttatcgatccacatattgatctatgtatacacatatagttaatgttatatctctaaatgcccaatgtttggactgcatcggtgtaaccctcggtcgtaatcgcgtggaaaatccaaaaaaaagtacccacccaccaccattttcccccacttttgcttaggatctcagagaaaagagagtttatcaacgaaagaaattaatatgattacggccggaatgggtttactggtcagttttcgggcagttgggcagcagatagtccagccatgactatagcgattattatcggagattccaattccaccccaaaaacactaaatctaagccatgtgtatgtagattgatctatacacatcaacgaaatgaaactaaattaatcaatttaattcgttttgctagaaacagaaaaaagaaagagacagctaaaaagcaggaaagaaagagagagaga

SEQ ID NO: 299 - DNA, 210 bp, Drosophila suzukii
agccaggaactgaagctagcagtgcaccagaagctgtgaaaaccggacgcactgcacctgcggcagcgggaagcgatgaggaaaccgttcaggaaactggacttgctccactgagttgctgcttctgcaatagacacctcaagtcggtgagcgctctgcggcgacacattgcatccaggcactcggagatccagggcaaggagcacgagt

SEQ ID NO: 300 - DNA, 574 bp, Drosophila suzukii
acgagtgcttcatctgcataaagagcttcaaaacgaagtggtccctgtccacccacaactcccgcttccatcgcgaaatgggctgctcctcgaagggattcagtaagatcgagtactccgatcactgaatcgcagttcgccattcattagaattaagtatgaagagtatacatacgtacaattagctcatattgtatcatatattacatgggtttctacttgtggcatgccgtttgttttctaattatagcaattactattggaaatcaaaaagttatacaaacgtttatgtcaattgttatggctaacttgtatactttgaataagtttgtatttaagaacagaaaccctagagtccaatttttattcaaaaggatttgatatattattttgtttgtcaccttgctcgcatcttttctgaattaatcgattgcgaagatattttaacgcatgtaaaaatgtaatctgttttcttaacaatttttgtagttcttggtcagggaaagtaattttaaaccattaaatgcgtggattttttaaagtaagaaatggtttctggttaaatctttctaaa

SEQ ID NO: 301 - DNA, 267 bp, Drosophila suzukii
acaccttccaaatggtccttgctaccgatgaggtctacacctatatcatcttcaactacgctgttttgaactggctttcgcacacagaggctggaggcgatacgacaaagggcgagggcggagttcctgcatatgtcggtttcaacgccggcaacggcacccaggcctacgagtacaagccctacagccagaacatggtgattcgggacctggccaacagaggatgggccaatgggttccctggtcgtcacattttccgcgtggacg

SEQ ID NO: 302 - DNA, 222 bp, Drosophila suzukii
gctatcgcctggatgtcctcgccgatggccgcagggtgtacttcgatcgggagagtctgaaattccagcacttcgatggtgtaaccgtgtataccccgacctatctgctcaatcagtcccaggtggtggtgcagttcgatgcgggaatcggagttgaggtcgtggagaacgagggctacatgacgggtcgcgtcttcctgccctggaagtttataaacaaaa

SEQ ID NO: 303 - DNA, 375 bp, Drosophila suzukii
atcctgcggacttcctgcccaccaatcgtacttacgatctggagagagctgaagaactctgtggagagtgcatgcagtgtcaatatgattatgcaatgaccttaaatcgagatttggcgcactataccaagaactactacgacaccatagtcaatatgcaggctgagaatgcagttcgcgtggtatcctgtggtgttttgcagacccctcgattcggccgaaagctgagctttgatttcatgcctggtgccaaggtgtcctttgagtgtaatgagggctttatcctggtcggagatcaacgtcgtgaatgtttgtccaacgggctgtggaatgtgcctgaatacggctacaccgagtgtctacgtgaggtgtact

SEQ ID NO: 304 - DNA, 251 bp, Drosophila suzukii
aacatcggggctaaaactgtaccgaactgtcatccctagaaacgaggcgaatacaaacggtggcaaattttacgtgtgttctcgtattattgtaaatattagtctttaataaacactaaaattaagtgccgacgtggtctggcgtgcaatcacactgagtaggctgcagaaaggtggactttccaccggaaaaagagtaatttaaagtacgtgtgctttccacgacgcagcggccattttgggcgaactca

SEQ ID NO: 305 - DNA, 432 bp, Drosophila suzukii
tttgggattgaggatgcgatgtcaagctgcccccacggatgaagcctcttccagcccagcagatttaaaactatgcgtgtgtggcagcgaaataaaaagaacaatcttccttcaagcactattatatggttttatttcaattgtaggattgcagagcctgagcggagtcactcggaaattccgccttgttggcgatttgttcttgcggttctagaattgacgtgaaactgcgcaccatcctagttcttctggacggcggcctgcaccaggggcaggttcttgcccaggaagcacttgaagccgcggaaggcccaggcgttggcgggcgacttctgctcgttcttgtcggcgcacttctcgatgtcggccttcagcgcgttcttgtcctccttgccctggcccaactgggccaccaggtggtccaccttgaag

SEQ ID NO: 306 - DNA, 342 bp, Drosophila suzukii
ggtggtccaccttgaagcccttggtctcgtcgaacaggtcgaacttgacgaagatgcactgaatgtagttgcgggtgatgtcatcgtcggggtaatcgaaggtcttgtacttggcgatcagggcttcggtcaccttgctgctggcggcgcactccttgcgcgcgttctgcagatcctctgcggtacggatcttgtactcggcggcggaggcctgacccaggagggcgcacagcaggatggcaacagcgttcttcatactggaattggacttttttttgctttctgagagggttgctcgaagtgatcgctcaatgggaactgttggctgtggtctgggctgct

SEQ ID NO: 307 - DNA, 296 bp, Drosophila suzukii
atgttaagtttacgagcagcgctaccaagagggagacaatttgccttagccctgggaaatgccactcgtcagatttccctccaacaaaactgcagatgcatcgccggcttcagtttagcaaaacccctgcaattgcaatcacaaaaactcgagcaatacaggtgcctttcggtgaagtcaacgaaaacagattccgaggatggactgcagcggatttactatggaaccctggctccccggatgaaggtggtcaagttcttttcgctcagcaccagcctagccggcttggccgccca

SEQ ID NO: 308 - DNA, 264 bp, Drosophila suzukii
tggccgcccagcccattctcctcgaacagggaatgaaaataggaggaactggaatgggtatattcctctgcaccatcggtgggttcttcacctttgtcaccccactgctgctgcactttatcaccaagaaatacgtaacggaactgcactataatccccaaacggaggagtacacagccaccacaatatccctacttctgcaaaagatcaagacgaaattccgacccaacgatgtggttgttccagaggttcccggcatgttca

SEQ ID NO: 309 - DNA, 214 bp, Drosophila suzukii
atgtttggggccaagctaaagcgtcaaatgttggccacttctccgctctgcactccgctctgcactccgcagcagatcccttcctggatccttcagatgccgctcattgcagccgccaccaccatattgacaatagtgagtggggccagctcctcctccagcgtcgcggagatggccaggaagcaccacccatcctatcacaatatggggtctt

SEQ ID NO: 310 - DNA, 207 bp, Drosophila suzukii
atatggggtctttgttcgacaatcgatggctgcccatggatcaaacgatgcagcagccccatcccaatcaccgttatggttcggccaaaattccaggaggcgatgcgggcgacaggcgagcctttggcagcagtggcagccattcctcaggcccccggcaaggattcgcctcgctgctgaacgggctgacaaatctctcgggcctgg

SEQ ID NO: 311 - DNA, 256 bp, Drosophila suzukii
gacaccatagtctttaagtaaagttttgcatttgctttccccaaacaatttccccctcatcccacaaaccgctaagctaatcgtattaaaagataaaaacagcttttgtttagagcgaagttttacacaaaggaattttgttgtgtaattgtatgtagatcaacttggttttgaagaaaacatttcgcgcctgagtcgtgacttagcaaaattccatgtccaagaatattggattacccaatcatagaatggtcac

SEQ ID NO: 312 - DNA, 261 bp, Drosophila suzukii
gcttcgtggtggtctatataagccacaagatctacgtgtctgtgtacgacaacctgccgctggccgccctgcccggaacttcacgtcaacagctcctgggattgcgtcactccaaccatgcgacgaccatgcgggaatacctggacggctcgctccgcaatccgcgctccaatcagcccagcctgcgctccgtttggatccagaaccggtcgcagatcctggagtcctcgtcggtcctgcgcatagtgctctccctggagc

SEQ ID NO: 313 - DNA, 200 bp, Drosophila suzukii
acctctccaagatcccgcggctcaaggtcatgctgaagtgcaaccaaaggcggccggaaccgaggctggacagccgggcgcagttgaccctggaagatgtgatccaggaggccaaggaaagccaggatgcccagtgcacggataacgccgctgcctgtcgacctgtgggctcgcgtcggaactcccggctaccggattaa

SEQ ID NO: 314 - DNA, 200 bp, Drosophila suzukii
agaggaagaagagcagatccaggttataggcgagacggagaagacggtcgagggtgcttccggcggtacacaggcagcagatggtggggactcacccgcccaagtagcccgcgatcgcaagtcccgttctcgaactcgcagtcgtagcggatccagttccggatcaggctcaggctccggatctcgggccagcagccgct

SEQ ID NO: 315 - DNA, 654 bp, Drosophila suzukii
gcagccgctcaaagtctgggtcacggtcgggaagcggctcccgatcacgctccaattcgccggcaggatccaagaaatccggatcaagatcaagatcgggctcacgttccaggtcccgttcaaagtccggctcgcgctctcgttctcgttctcgctccaagtccggctctcgatcccgttcgggatccagatctgggtctggatcacgatcgcccagtcgttcgcgcagtggctcacccactggatccggttccagttctgggagcggttcggatgaatagataagtttaaaagaccgtttcatgttaaacaagattgtaatcaaacaatgaaaggtgtacttttaaataatcattaataactggatacaaatataattttaggaaataaactaattttcaagatcgttaataagtaaatttcgagtttccaaaaaagattaaatatttttgtatttaacccatgtcgggtgtcatttgatttagactttggcgcacaactttaaaaataaaccggtctacgttggtaacacttttaaagcaaaaattccctgcaaaagcaataagtggatccatttcttaaattgagaatttaatttaaaatcgttaattgaattgattcaagcaatgaaaaatgtttaattttagataaaca

SEQ ID NO: 316 - DNA, 237 bp, Drosophila suzukii
taaatcaatgcatgccatgaatgaggagcataattacgaaacgattgcgccagctggcagctataatgcctttaaggattttacctggcgtcgttccccgaagaaatccggaggaagtggtggctgcaaggcacgtctatcggttccagaggcggccgaggagaagctgaaccaggaggccttccggttggccagaaccatcaggaatctgctccacacctcggaacagcagccgga

SEQ ID NO: 317 - DNA, 268 bp, Drosophila suzukii
accagcgcttctccactttatcaaacgaagatgcagccgctgtatttgcacaagtgcagagtttcgagttcaaggagcagcagaaggatcagcatcaacagctagagaatctgcagaaccatccgaaccaggaaggtgtgccaccggagaccaagaaccaagaactaatcgatgaagacctataccatgtggagtacatacatcccttggagcatgtgtggaccttatggtatttggagaacgatcgctccaagcactggaaggacat

SEQ ID NO: 318 - DNA, 240 bp, Drosophila suzukii
aacagggcgatgtggcagctgcggctaatgccagcgaggagattatctacagaatcgatattcctgccaaccgatacgatctgctgtgtctggagggactggtcacgggtctgctggtgttccagggcaagctgaaaccccccaagtttcagtttgtggagcccgccaagaggcaggtgctcaagattgacccgtcgacggcccagattcgtccctatgccgtggccgctgtgctccgga

SEQ ID NO: 319 - DNA, 244 bp, Drosophila suzukii
tgatctacgatgccaaccgagtggtgctgtctctgccgcccattatcaacggcgaccattccaagatctcgctgaagaccaaaaacgtgttcatcgagtgcacggctacggatcgaacgaaggccaaggtggtgctggacaccatcgtgtgcctgttctccgagcactgtgcccagaagttcacagtggagccgtgcgatgtggagcagcccgatggcagtgtactctcctatccggaactgga

SEQ ID NO: 320 - DNA, 228 bp, Drosophila suzukii
aggtcgatggcgactcgctagtggtcaagatcccacccacgcggcacgatgtgatccatgcctgcgacatttacgaggacgtggccattgcctatggctataataacattaagaaatccctgcctgccttcatccagatagccaagcaattcccactcaacaagctgaccgaacaactgcgtgaacaggtggctcaggcgggattcactgaggcgctgacctttacgc

SEQ ID NO: 321 - DNA, 202 bp, Drosophila suzukii
aggcgctgacctttacgctttgctctcgagatgacattggacgcaagctaaataagaacattgaggccctgccggctgtccacgtcggcaatccgaagaccctggagttccaggtggtgcgaactactttgctgcccggtctgctcaaaactttggtggccaatcgtaagatgccgctacccttgaagctcttcgagatcag

SEQ ID NO: 322 - DNA, 281 bp, Drosophila suzukii
gatcagcgacgtggtggtttcggatgagagcaccgaggttggggcacgtaacgagcgaagggtgtgcgctgtgaactgcaacaagacagctggcttcgaggtggtccatggtctgctggatcgcgtaatgcagttgctctccgtgccctggaggtcggccaacgtaactaagggatattacctgcaagccgctgaggccaacccgggattaaaaagcgatcaattcagcatgcctaccattggagttaaacgggatctgctgttcgaggcgctcggcaaga

SEQ ID NO: 323 - DNA, 240 bp, Drosophila suzukii; identical to SEQ ID NO: 318

SEQ ID NO: 324 - DNA, 244 bp, Drosophila suzukii; identical to SEQ ID NO: 319

SEQ ID NO: 325 - DNA, 202 bp, Drosophila suzukii; identical to SEQ ID NO: 321

SEQ ID NO: 326 - DNA, 266 bp, Drosophila suzukii
gatcagcgacgtggtggtttcggatgagagcaccgaggttggggcacgtaacgagcgaagggtgtgcgctgtgaactgcaacaagacagctggcttcgaggtggtccatggtctgctggatcgcgtaatgcagttgctctccgtgccctggaggtcggccaacgtaactaagggatattacctgcaagccgctgaggtatgctttttatttttcatttcagcggaaaagctggccgatatgctgacacgcatgtatctggaggcca

SEQ ID NO: 327 - DNA, 490 bp, Drosophila suzukii
gcaagctgaacaagaacattgaggccctgccggctgtccacgtcggcaatccgaagaccctggagttccaggtggtgcgaactactttgctgcccggtctgctcaaaactttggtggccaatcgtaagatgccactacccttgaagctctttgagatcagcgacgctttttatttttcatttcatcctaaatggtattacgaacaggttttttttaagtttattaaacactcacgtgcttatcgtgatgatcccacacttccatcttgtccggcatgtgtgcggcgatgtcgaccgctccaggagcgcccacaaagtgctggtagcaaaaacgtgttcatcgagtgcacggctacggatcgaacgaaggccaaggtggtgctggacaccatcgtgtgcctgttctccgagcactgtgcccagaagttcacagtggagccgtgcgatgtggagcagcccgatggcagtgtactctcctatccggaactgga

SEQ ID NO: 328 - DNA, 288 bp, Drosophila suzukii
gtgccctggaaatcggccaatgtgaccaagggttattacctgcaagccgctgaggatcccagctactttcctggtcgctgtgctaatgtgatgtacgacaacgttgtcattggcaagattggagtcctgcatcctacagtgctccaggccttcgagcagtttattaaacactcacgtgcttatcgtgatgatcccacacttccatcttgtccggcatgtgtgcggcgatgtcgaccgctccaggagcgcccacaaagtgctggtagccgtatgagggcatcaagttga

SEQ ID NO: 329 - DNA, 450 bp, Drosophila suzukii
caaaaacgcagtgttttcggttcaaggaggtgatgtggtaactatgtgaaggaatcgtatgccagttggattttaattcttgagtgatagtcttgttttcaagctaaagaaccggttgtttcccaactaatcagctaaatatatgaagtttcttttttgtcacatttttatcaatattctacattacttaggcatttaactccctttccacaagacttattccgcagaaacaattattaaacgttctttaaaatctgtaaattaacttcgaaaacgtttccttccttgaaacggctgtctttgaaatttataataaatgtaaagtcctcactgactattaaattaaccattatcgttaaatattgtaatttctaaagaatttttcttgaaatgagataagattttgacatgaagttacgcattagctatttgtatatgaaattcttgaat

SEQ ID NO: 330 - DNA, 209 bp, Drosophila suzukii
tatatgaaattcttgaattctatctgaaagtataaccgaaaagggattttggttattgggtaaatgtggaatattaaaaacataataaaagaactagagataggtacacatgtagatatttttttaatttcatttgttacctattaattccccaaatgaattagcttaaaatgacttttctccttaaacccagaatttcctcgcattaa

SEQ ID NO: 331 - DNA, 429 bp, Drosophila suzukii
ccggatccggatcgggaaccggtagcaacagtgcagcctcgtcatacagtgaaagcagcgccatagccctggccgtggtttctggctcctcaaatccctacagctattcacgatcgcatgcgacggataataccagcagcagccagttgaatcaacagcatcagcaaaatgggccgctgatcatcaagaaggaacccttggatcaggactatcaagtcagccagaagcgccggcgtttaagtggcggcgataagaagtcccagcagcatcagcacatccaggatgaggacatgttgataccgcccggcggaagtctcctccgcaagaggaacaacgttagcaccaacagcaaccagaccagatttgcgggcatggtcgagaatatgaaatacctgagacccgatacaccccacagtcttaccgacgagg

SEQ ID NO: 332 - DNA, 255 bp, Drosophila suzukii
taccgacgaggtggccgccccagaattcagacataatgtggatttgcgtgcctgcgtgataggcagcaataatatctcactgaccatcgatgatggcgatgacaattacatccagcagataagcagggatcttcagaatgttggcaaggataagctctcgatgcaattcccaacaccggcattgatcgatgtcctcgatttggtcagccagcagcagaatttgacaacaagcaacaacaataaccaacagcagac

SEQ ID NO: 333 - DNA, 507 bp, Drosophila suzukii
cgccgtcctactcgccgctgtccgtggactcgagcagttccagctccagttcgcactcggacttcaccacctcgacgagttccaacaagcgcaagcgctcctgcctgaaggccccaggtggcgtcttcacctgcaggagcagcagtggcgtggtcatgccgggaggcggcactatgatgggcaagaagtgtcgcggcaagaaggtggtcagtccgtcgtcctcttcgtcgggcagcatatccccgctgtcggctgggtccaaggatatggatcccatggatcgcatttggcagcgacgcactggtggaaccagtggcatgacctccagcacaagtgccggcagcagtgtcctccggaaggactttgttgtgggcctggacgaggccgatacgatcgaaaagcgtaatcagcacaacgacatggagcgtcagcgtcgcattggcctgaagaacctcttcgaggctctgaagaaacagatccccaccatcagggacaaggagcgggctc

SEQ ID NO: 334 - DNA, 201 bp, Drosophila suzukii
gagaggcggtcttcgccgagatgggcgtggccgtcaaggaagacggcatcacagtgggcgtattctcacccaagaagactccccatctggtcaacctcaacgaggatcccaatctctccgagtgtctgctctattacatcaaggagggattaacccgcctgggaacccacgaggcgaatgttccccaggacattcagctct

SEQ ID NO: 335 - DNA, 350 bp, Drosophila suzukii
tggttgaaccggaggttctgaagaccggctctcgagtgatcctgggcaagaaccatgtgttccgtttcaccaatccggaacaggcacgcgaactgcgtgagaagatcgagaccgagaatgaagcggagaacgaggtggaaaagacggacacccagcaagtggactggaactttgcccagtgtgaattgctagagaagcagggcattgatctcaaggccgaaatgaagaagcgattggacaacctggaggagcagtacaagcgggagaaactccaggccgatcagcagtttgaggaacagcgcaaaacctacgaagctcggatcgatgccttgcagaagcaagtggaggag

SEQ ID NO: 336 - DNA, 207 bp, Drosophila suzukii
ggtacaattccagtttactctcttgactgacaccttgtactcccctctgccacctgagttggcctccagtgtggctccttcgcatcaggacgatgagtttggagcacctccagtgtccaaaaccttggtggccgtcgaggtcaccgataccaagaacggggccactcatcattggtccctggagaagctacgctatcgcctcgagct

SEQ ID NO: 337 - DNA, 282 bp, Drosophila suzukii
tccagcggcgcattcgtatcaccatcgtccatgagcccacagcagaggtcaagtggaaggacatcaacgagctggtggtgggacgcatacgcaatactccggagtcatccgatgagcaggacgaagacgcctgcgtcctgtccttgggtctgttccccggcgaagtcctggaggtgcccggagacgatcggtctttctaccggttcgaggccgcctgggactccagtctgcacaactcggcgctgctcaaccgcgtctcccagggcggtgagaccatctaca

SEQ ID NO: 338 - DNA, 223 bp, Drosophila suzukii
ctgcggtgcggacctcgttcgggagttcgagatacaagagatacgagaatcgattcgtgccaaccaactaaaaaagccgaccgaaagatacggggaacagcgattttactacgtttgtggtttggcagcgtcttttgtttttcggcatcggttttttcggctgcccgcggctaaacttgaaattaaagctgattcggcgaagccagatacaagatacatatgc

SEQ ID NO: 339 - DNA, 217 bp, Drosophila suzukii
tgctgcagttcgaatgccaccaatgcggacctagactacgatgtgcctgtctcgcggcgcatcctcattaaatcgattgagccatcctggagctggcgaggaagctatctgcacggctcatctgctgttgtgacagttgggctgcaaaaggaaactcaacaccgtttgatgtgccagtttacggcgcagaaactttatgccaaggccatttacgata

SEQ ID NO: 340 - DNA, 273 bp, Drosophila suzukii
ccatctgctcggcggagatctacgagaacggttccatcatcagtgcggcctcgtcctcgaactccacttcgggaggggtgaacggaggatcgggagcggagtccacggcggctcaccgcggaacgagaagatcgtggcacgtctcgccgaacaaggtaatcacaccgcagaggcacggtgatgtgtacatctacaactgctcaccaggatcagctactggaactgggacaggagcagcccaagacacgccgcaccagcagcagatctatagca

SEQ ID NO: 341 - DNA, 514 bp, Drosophila suzukii
gaggaggagtcctacgatgtgccacggcctctgatctccggaagcagcatacttcagcagcagatgtcccagatgacgccgagcagctccgcctcctccttgctgaccaacgacagcctctcgttaagcttctccagctcgaaccggtcctcgttggccaacatgcccgactacgacatcccacgtcgcaatccacttcctgtgcgtcgccagcagagcggtctggcctacgacttcccgctgcccccgctgcaggagcaggagcagcgagtggtccccactcccgcaacagtcacatcttccaaagaactgccgctggagctgagctcggcgctggaaacactggccaagctgcagcaccagacgactgccgccatcagccggctgctaagctttgtggtgcccaactggcgcacccatgcacaactggagccggccatcatggagctgaaactggctgccctgcgtctgcgcacagctcttcacgacctggccgagttcggggagggagccc

SEQ ID NO: 342 - DNA, 285 bp, Drosophila suzukii
tcggggagggagccctgggcaatgccacccgatcagaagatcgcaacctggccctcaagttgagacccttggtgcgagctttgcgtgatgccaacaagctgatacacgactcctccgaatccctcgaggcccagggcggctggtccgtggagcaactctcccgaaacgacgaaaagcacggctgccgaccacctgacgcactggaccaattgatggcctgtgcccagacgctcaccgaagatgtgcgctccaccaccagtttcatccagggcaacgcctcgctac

SEQ ID NO: 343 - DNA, 312 bp, Drosophila suzukii
cctcgctactttttaagcgacaactggtcgcggaacagaatgtaggtggtgcgaccggagcagttgagggcagtcgtggaagtgccgagtggctggaggattacgactatgtggccttcgagtccaaggacgcggccgcccgaaagaaccaggcgctgcgtgaggccattcccgccgggctgaagacgcagttcgatacggtgatccgcacggccgagagctcggccatgggcggcacttctggatcgattcccaccacgcccacggcacccatgacgccctgcaagtcaccggagatgaccgacaaagaca

SEQ ID NO: 344 - DNA, 234 bp, Drosophila suzukii
acaagaagctggtgcgctattatgcccagcagatctccacgcacatgggcaacctgatgcaggctattgactccttcctggagacggtggagaagaaccagccccccaagtttttcattgcctacggaaagtttgtggttgttagcgcccataatttagtgaccatcggcgacaacgtccaccgaaacatctcaaaggaagcgctgcgggagaagatcctgcgctgcaccaacg

SEQ ID NO: 345 - DNA, 2099 bp, Drosophila suzukii
gcaccaacgccctctccgacgccctgaagacctgtgtctccaagtcgaagaaggcggcggcgcacttccccagcggcagtgcggtccaggagatggtcgactcggtggtgcatatcaatagcctggccagggaactgaaggcggtcatgctgcaggctgtgcatctttccactgcggcgggctggcctccgttcccgttcaccgaaactgaaacgatcccccacacccattcgcccgaactaggcgaatcaggaggccaccctctgtccatcacggatgccaggactctggaggacgaacccattgaagttgcggacgatccccaggaagcgaccgcaaacgatggggaggacgacgatgtgcacgtcgaaagaaagccttcgacgctccgctgggtgaccactgaagagatccgcgcttggaaacagtgtccgcgctgtcggaggcatcgcaccacaaatgttggctgggtcaaacatgcccagaaatgcgctcaggacgcctcgtacaagcgagccatgttttttatctacacccacacaaagggttggtgtaactatctggttaggaactccgtttgggatcggcacagtaatggccagtgcacaacctgctccgcatcgcggcgtgagggactacccatgcccttcatgccggatccaccacccaggccaaatgaagactacttggccaagatgcgacggcagagggcgagagaacggcgggagagagaacgatgcaaaagaactaatgcccgcgttcctggagacagcgcagcgcaattgtcgcctggatatgagcatagaacgccacgtatcccaacaggcccaaatgctttttcttcgcccacaggaaatgatacgactatctggttaggcactaacataatgagaaccacagcaatgcgattgttgtccagcgacgtgagggattagccagaatctttagtgatggatccttcactggggcacaagaaggcagaatgggctgcccttagaagaaaaatgtggggaattaacgccactgaaaatccaacttcacactgtaacataacgttgtttttacaaagtaaataaatgttatcgcgatcacagcctacgcgttcttggcgcaccggaagcccaggttgccggccgagctgtcctctgtgttctgagatcgggccgcgcacctgtaccggtagcagtaggacttgtggcacagatccgcggtccactcccagacgttccccaccatgttgtgcagatcatagacgttttgccggaaggtgtccactgggctggtgaactcaaagccatcatcagccagattgccatcgggaaagtcgccttgccaaatgtttgtccaatgctcgcccctgggcatcagcttgttgccccacgggtaaagttttcgatccttgccgccgcgacatgcggactcccattctacttcggtgggcaaacgcttccccacccacttgcagtattccacagcgtcgcgccacgaaacgtgcgcaaccggatgtcgccccaggttttccagactgctgtccacgccgttgggatggcgccagctcacaccggccaccttgtaccaccaaacggcgctagccacgcggaagtcctccaactccctctgctccgatggactcagaaggctcttgaacagaaaactatcgccaaagcgctcggcctccgtggtgtagttggtgtccagaacaaactttgcgaaggcgtcgttggatacttcgtacttgtccatgtagaagtcctccagcttcacttgacgttccggaccttcccgatcggccggaaagtgcggattgtcggtgcccaacagatagcttcctcctggaatgagcgacatatccgcgatttctgcttccagttcgccatagtaatcccggtagtggcttgcaccctgcgccctttgctggcacacttgatctggaagcggcgccttttccccatcgggcgttgtgttgcggtcgagcttctggcagccacagtcgctggaggcgtcatggaacagaaatatccagataaaaataggaattgttttcatgttgcggattagctagtgatggcgatgactcgatgtttctgttgaaatcgatg

SEQ ID NO: 346 - DNA, 474 bp, Drosophila suzukii
acgactcgtacgaggtgtccgaacacaatgcggaggacagcacgggatccagatccgtagcaggatcaggatcattaccgatagtttcacaagatgcggacaaggagaacgttcctttgcccggccatcatgaacgaagcgtcaccgactccaccctaaatttgcagaccagcgtggatgtcaccatgctgcccggcgagccgaggatctcatcatcccggaacgccaacaacaccacctccatctgtctgtcctccgaggagcgaaaggcgctgcagagcagcctctacgatcaccgggcaatggacaagacctatgatctgatgtcgcaatcgctgattacccgcatccaaagccaaaccagccattttgaggatccctcattcgaacagccacccatcgaaagggtaaaaagtgtgaataccccagtggccaaaggcataagtgactcctttatggacatcacgccattgg

SEQ ID NO: 347 - DNA, 473 bp, Drosophila suzukii
gaaatcgcttttcatggacatagaggaggcggccaggaagatcaagaataaaacccaacttggaccagttgatatatccttcgattgccctttaaatgtatccgaggaccgggatcgctcgccgtcgaactcctttgagagcaacaatagcaccatcaacttcatgaaggatgagtccatgctcataccattcgacatgatctcggggaaaaacattagtaagaaactcaattttcgccaactgaacgatgaactggaggcgggaaagattcagttgtttccaaatggtccaaaaacgcccacaacagatcggaagacaacgaaaaatcgtttttggcaaggtctggaaggggaagatagtagcccgcggaaggatataagaagcattaagccacgggcaattttgaacttcagcgagaatatgaccatgtcgccggcgccaacaagtccaattcgaaaagaaaaagataaac

SEQ ID NO: 348 - DNA, 486 bp, Drosophila suzukii
aagaaaaagataaacttaaggtgatggatgacaagcggaaatatcgactttcccaggcggatgagataatgctggacaacacaaatttcttggcccatgcgaaattgggcgatgagactcagtcgagaaataactccaagaactctacgagacgggagacaacctatgacaattccgagttgaatttggaatatcccataaacagtcatagctttcatcccattccgagctccaagcctcgacagactatttgcaaagctgaggaaatgcagcaggatctgttagatttgcctgctatttcgggtgtgaatgccgttcccccacgtcgcactttacacctcaatgaatccatggatcaggaagccaccaagtctatgcacgtgaggaaggagattgcggtgaccacggagcagactgtctatgaaaaatctacaactagccaggagaacgctaggaaaggcaccgtttgggcctgcactaaaacca

SEQ ID NO: 349 - DNA, 346 bp, Drosophila suzukii
cctgcactaaaaccaagcgaagggagacccttttgttgcaggaaagcatggacatcaccagtccttgcaaggatctacatttggaacccacatttgctcctgccgtcaatgtccaacccaaagctaatcacactctttatttagcagaacctttggaagaagaggaactcaacagaagcgatatatttcctctaacaaatgtagcccaaaaggaaatcaaatccaaaccgagacaaactatgttattggaggaacccatggatgagagtagggatatgatggatcaacctgtctataattcgaaaagaaaaacactccacttggtggaacctctggaggaggagga

SEQ ID NO: 350 - DNA, 289 bp, Drosophila suzukii
acctctggaggaggaggaagtcataccagacaggcttttacctacgaaaacctttccgcatcaagaacagaaatccaaagccaggcaaactctactgttagaggaacccatggaagaggaaatgttcaataatgaaaaagagccggtaatttgcgatgcaaaaagaaaaacacttcatttagctgaaccttttgaagaagataaaacaatcccagttaagaacttgtcgaatcaaggaaagaaatcaaaagctaggcaaactcttctgttagaagaacccatggaagag

SEQ ID NO: 351 - DNA, 473 bp, Drosophila suzukii; identical to SEQ ID NO: 347

SEQ ID NO: 352 - DNA, 814 bp, Drosophila suzukii
aagaaaaagataaacttaaggtgatggatgacaagcggaaatatcgactttcccaggcggatgagataatgctggacaacacaaatttcttggcccatgcgaaattgggcgatgagactcagtcgagaaataactccaagaactctacgagacgggagacaacctatgacaattccgagttgaatttggaatatcccataaacagtcatagctttcatcccattccgagctccaagcctcgacagactatttgcaaagctgaggaaatgcagcaggatctgttagatttgcctgctatttcgggtgtgaatgccgttcccccacgtcgcactttacacctcaatgaatccatggatcaggaagccaccaagtctatgcacgtgaggaaggagattgcggtgaccacggagcagactgtctatgaaaaatctacaactagccaggagaacgctaggaaaggcaccgtttgggcctgcaaaaccaagcgaagggagacccttttgttgcaggaaagcatggacatcaccagtccttgcaaggatctacatttggaacccacatttgctcctgccgtcaatgtccaacccaaagctaatcacactctttatttagcagaacctttggaagaagaggaactcaacagaagcgatatatttcctctaacaaatgtagcccaaaaggaaatcaaatccaaaccgagacaaactatgttattggaggaacccatggatgagagtagggatatgatggatcaacctgtctataattcgaaaagaaaaacactccacttggtggaacctctggaggaggagga

SEQ ID NO: 353 - DNA, 292 bp, Drosophila suzukii
acctctggaggaggaggaagtcataccagacaggcttttacctacgaaaacctttccgcatcaagaacagaaatccaaagccaggcaaactctactgttagaggaacccatggaagaggaaatgttcaataatgaaaaagagccggtaatttgcgatgcaaaaagaaaaacacttcatttagctgaaccttttgaagaagataaaacaatcccagtaaggaacatcttgtcgaatcaaggaaagaaatcaaaagctaggcaaactcttctgttagaagaacccatggaagag

SEQ ID NO: 354 - DNA, 998 bp, Drosophila suzukii
agaacccatggaagaggaaccggcttttggagatccttttggagcggagaacttaatgactctcaccaaatccagaaaaaccctaactacaacagaatctatcgaggatgacagttgcgttccgctactcaagaataagtcaatagtaacgcaaaaaacaattgatagatcaactgcaccgcagcgacaaaaatcaaggcacactcttataatgtctgagcccattgaagaagaacaagttgcacccattcagtgccaacaacagtcccgcttgaaatcaagaagcactgttcttctccacgagcctgttcaggaggattttgtacccggaaaggatgataattcagttgggcagcatggactgaagtcaaggcaaacgcttatcatgtcagaacccattgaagaagatgtagaacagccacgacctgaatcctttagcattttcatggatagtcagtgtgacgataagttgcaaaccaaaaaggcggattctacgacttccaaagcaagtcgaactattcttatgtcagctccagtagacgaacatgtgtgtaagctaaaacccatgaatcgaactaaggaactattaaccgaggtgggacataaaaacacatcatctaatagatccttaagatcaggatcaactcttcgaatgacggaacccatagaagatgctcataagtctatcgctcacaaaaatgaccagtctcatcataagtcaagaaatactaagttaatggaagaatcttttggagaaatgacaattaaaagcggtagtcggccatccaaatctcgcccaaccatccttacggcagagcccatagaggaagatgaggaaatatataaatctacggctaacaataataaaccgtctaagttaatgtcaaatcgcactaagcttatagaagagtccattatggaaattgaatctgaagaacctgttcagccatccaagcctcgtcaaactctccttggggcggaacccatagatgaagatg

SEQ ID NO: 355 - DNA, 1920 bp, Drosophila suzukii
aacccatagatgaagatgaggaaatatataagtctatggctaacaataatgatcagtctaagttaatgtcaaaccgcactaagtttatgacagaatccattatggaaattgtatctgaaaaccctgttcagccatccaagcctcgtcaaactctccttgtggccgaacccatagaggaagatgaggaagttcataagaagccaaaagatcacatgatcactcattttgtcgaggattctatgcagcagacgacaactaaagtgaatgaccaaagaaggcgtcagacgcttgttaatgccgaacccatagaagaggatttggagctccttaacccaatgaaaaattctatggaccagtcattgctaaaatccagacttactgaccaaacatctaagaatcgatctaaatcaagacacacccttgttatggcggagccaatagaggaagattctgagcctgttaaaccaagaaatcatcgtaggagccagcatcaccagaaacccagaaatactctggtcgcccatgaacccattcaggaagacattgtagccggggtggaggaaaattcccttgagccccagatatccaagcacaggaagacgattcttatggcagaacccattgatgaagatacaagtgtctataataaaagaaagacaagtaacagcagtgagtatcatttggaaagtaaaaatacaagcaactctagaggaaatacgacgtccaaatcgagacaaacgttgcttataccggaacccattgaggaagatgatatttcatttggtaactatcgagaatccaaaaatgtggccggaactacgctcccttcggcagaatccattaaggaaagtgtagccgctacatctgatgtaaattcaaagcatttttcagtggatgagaatttaaggaagacaagaagtactcttgttcgcgcccaatccattgagattgaaaaggacacgattcctacagcccagtcccccagaagacatactttgcttttatcagaacccatgaatgaagatgaggaattacctggacacaattaccccacaaatgaaaagcaacttcctgaaaaaccaaaaaaaggcgttttaaatgctctcaaggatactacttttggcaactccttggaaagggaagagggagcgattccttccaaagttaaagcccttcaaaccatgcttatcacccccgtgcccaataccaggatattatcaagaattagtcaattcaccacctacacgccaggaatgtccttgactgagttcgaggatcaggaagagatgagcaagataccgattcccgaaaaaaaggatgcggatggggagcagaaggagccatccattgaaatagacaacgtacggctcagcctggtttccacgctggccgaggaaacggacgacgagggtgtggaggaggaggagtgccaagaggagcatccaccaaaaactgaactctgtgaggatcagccagtggttattgccggcagcagccgctcctgcaagaagtgcacaaattgcaatcaatccttaagcgaaacgaagctaagtaacgactccttcgtcctgccacacaagaaactgtgggacttttcaaggcaacaacagcggttgcggatcatcaggcagaaacccacaatgaaggaggtcaatctgtactgggagctcgaggagcagacccgcatgtccaggtgccacgaaacagacgattccatggatcaatcgagagtagaggaggagccaacgccatgggacaaagcggcgcttttagatctgtgcaagatacgaactggtccaccgaaggcttcagacaagcccacggaatccttctttgaacgcctcaaatgtttgctggccgagcagcagccaaactggatctttgacttccaacgcaagatatcccagcaaatgatatttt

SEQ ID NO: 356 - DNA, 491 bp, Drosophila suzukii
ccagcaaatgatattttaccaccgcctgctgaccacgttccgagttgtggtcaactacaaaatcgaggacatggcggaagagtctgccattagtgtgtgctccattgagttggacaacgaggtgaccactcgaaaagagcactggacatcgtgcgagcactttttgaactttcaactgagtctcagactgccgctcaatcttaccgacgccattgaaggcagcgatgagacagcttttctgaagttccttaaacatattgatcagaaaattgtggagatcaagcaaacgttccatagtcttctgaccgttttaagggagaagagggcgaggctcctaagagaagcgaatcatactattgtaaaaaagattgtgcggaaatgtatagaggacgaaccgcttgtgcgtctggagaagacgagtttcgtgattgatgtttcaaatatcgaggaagtgtccttcatggacatcctgcgccccgaactgcatctct

SEQ ID NO: 357 - DNA, 361 bp, Drosophila suzukii
gacaagctgcaggaggatgagaagctgtacggcaaggagactctgaacgtcctagagacatccattgagaactccatcagcgagtcgcagaagatctttacggatgtgttggtacgcaaggagaaggccgactccaccaggtccgtcctattcgccctgtcgcgccacaagtttcttttctgcctgcccaactcggtggaccgacgggccaaggcgggcgaatacgacattgtggtcaacgactattcgcgcgccaagaatctgtttggcaaaacggagattcccatcttccgcaaggtgctggaggaggtggacctcaggattctgtccatcaggaagcagctgcacgagaaggtggtca

SEQ ID NO: 358 - DNA, 201 bp, Drosophila suzukii
gggatgccatcgaggccagggccaagtacctggaaggtactttccgccagaccttcgagcagcacgccaacaaggatacgagtgcgcaggagaaggccaaaaacagggatcccagccaggcgcccagtcgggtgaacttttgcgaggagctgtgcgacattgcagcctcccaactgccagatttgtggcgtctgggccagc

SEQ ID NO: 359 - DNA, 300 bp, Drosophila suzukii
tgtggcgtctgggccagctttacttcactggggagctgcgaggacctcatgatcccaaaccaggtgactttaagcgcatgattttgaacgccatcgaaaagttctgtgtttacttgcgcttggccatacttattgccgcggatcagcgcgccttgaggcagtccagcggcttgtcttggtctattggctctgcctcggccacgcaccagttccttccctggattccgcaatgcctgcgcttcacaaggatagcctatgctacactcataagcttggatcttccctcggaagcgctggaca

SEQ ID NO: 360 - DNA, 208 bp, Drosophila suzukii
tatgcgtactgcaacaagagcttcttcccgcgcatcggcgacattttcgtgcgctatggttacccgctgcccactttggcaatcgaaacggcacggtacacggtcaaccaactgtttaccaacctcctggaagagtacgtcgagcacaagggcgatcctctggtaggcaccatagagccctccatgtacctgggtcgtttccagtggg

SEQ ID NO: 361 - DNA, 385 bp, Drosophila suzukii
gaggagctggagaagaagctagatgcccaggctcagacctgcgagaatcttcaagatgagctgcaggtcaggggactgcccgcggatgccaaagatgtgctctccatactgatgcagctgtcccagcgtctgggcgacgatagtggactcctgcggcgggattacaacatcatgaaaaagctaaaggagcacttcaagacgctggatataagtctgcccacgccgaaaagtcccaatccacgcagcaaacggaagagccatcagcctggggtcaaccaatccacgcaaaccgacgtgaagccggttgaggccaagcccgcactttgttctgtggccgtacaggtggagggtctaatagagacccgtaaccaggccacgcagcaca

SEQ ID NO: 362 - DNA, 262 bp, Drosophila suzukii
ccaggccacgcagcacaagaacaccaccactacgcggggcaccacaacagcctctttcatccggcatcaagatgtgggcacctgctttcccgagcccactcccctgccaaatgtgcggcagatcctcgatgaaatgctctcgtggcatcaggatgtaataattgaaccgatgagtccactgagcgacccgcagccggagctggaggaacttccagccacagcaagtgtggccacctgcactaatttgtgtgatatacaccgc

SEQ ID NO: 363 - DNA, 250 bp, Drosophila suzukii
tcgcccaacatcagccacggaggagatgtgactcccatccgcctgccctccaagtccagagaacgaaagcgaaaatccaaaaagcgtaaagctgttgcaatggcgaagcctgttcccaaacgaaactgcctggagatggggccagtacgtctggagacaaataatgaaccaggtgtagaacatgaacaaaagccagaaacggcaatccagtttttaagcaatttgaaaacatttaacatggccaactgtg

SEQ ID NO: 364 - DNA, 614 bp, Drosophila suzukii
aaagaagaaaaggaagaaatcattagggacgaggtccctgaagacttcgaaagccctgcggaaaacactaagttcctactgccagaaaatagtactccagatcctttgtgtgcaggccagaagggaaaaggttcgtctttaaaagatgatgacggagaaccagctagtatggaactccctcggcagccacataaaacgcaagattcggaagtaccttccttaaagaaaccagaaatcgagttagagattaagagcccaactgaattcgctccaattgaagctattccgttgcatccatccttatatggcagcgcttccgatgtgaaatcaaatgagaggaaagagtcgttggcagaggaaagattatattccgatttaaacgcttgtgaggagttgcaacgtatatcgagcaaaagagatgatttttcaacagaaggatcgaaatcacccttgttcagtagtgactcaaatctggatgagagtacaacgaaaagtgttaatgatactgtgcccacagacttttttaaatcttcagaagagccagaaagctcattgaatcacagcgattgtgatattttaccaacttcaatgtcactttttggtggttttagtga

SEQ ID NO: 365 - DNA, 1018 bp, Drosophila suzukii
tttggtggttttagtgattcagatccggaatccgaattgagcgaggttatgatggatcccgaatcaagcaattcggaaaatgaaagtgaaaaatgtagaatttccattgaccacaaagattccaaacttagaataaatacttccttgttcggcagtgattcagaatcggatgaggaaagttctgaaccagaaggaaagctggaagaggaggatgtccttaaaaatgctgccgaagagcaacctattaaagaacatgctgataaaaatgaagatgaaatagcttccatagcaccatctagtgtgcctttacttactgaagccgatttgattaccataaagcaaccttcagtcatggaaaactcaggacctgattttaaagtaaaaggcatccagcagttcaagaagcaaatcagctctaaggtcactgaaaacacaagtgatgattccgaggacgagaacagtctgattatcgacgaaccaatctccactaagcaaccagagaaaccaccttcaccttgtcaaataccagctaaacggaaaagaacaaaaagcgagattaaaattccatctccgccgggacctgttcgtttgactcggcagagggccaagcaactgcttgacgaacagaaatccagtccagaaaaaggactttcgcttgtagaacgaattaggagccagctcaaacaaggatttactgaaccggagccttttaaaccaattgagctagaaaggcaacagacaaagaaggcacttatggaaccagaggccattaagcacaccttttcattcagcgaggagtcaccagcctctcctgtttctgagacaactgacgagctagtcgatccacccaccgaaatccccttagagcaatctataatcagcggggaagatggccaacccaagtcgctcctacaacatgtaattgaaaaggacaaggaggtggccaaggtcatccaggcaaaaaggaaaacactggggaaattgcaacctcaactgtgcgcctcaataggcaaatatc

SEQ ID NO: 366 - DNA, 252 bp, Drosophila suzukii
taacagtaatctgcaagattggcacagatgggaatccagtggaacgtctgttaaatgccctgaagtatttcaatttctctcagagatttctggctgaactggaggagcgtctgttccgaaacaccaaggagcggccagctactgaggtggctctgaaatacctgaaactctacttgaaggcggtggccctacaagcgagcatgtcggcaaaggggtatcaaaatccagctaggctgctgctggccaaaattc

SEQ ID NO: 367 - DNA, 229 bp, Drosophila suzukii
agtacgacatgcaggatccggagggcgctgaacgaatgctgctttccaagctgcgctttgagtatcacttccagccctttgagcccaccaaacagcaggtgttggagaacttggtggggaaacttaaggctggtcgtatggaggagctgggttacgccttcgcgctcttctgccggcgttctgctcatctcaaggttctggacagcgtgctgggggaacacctaatgcc

SEQ ID NO: 368 - DNA, 237 bp, Drosophila suzukii
taatgccgctcgccaccagctactgtgatctcgctgcccaagacaagtcatacgatgcccggctcgtgcatctgctgcactgcatctccttagttctgaagcctcttcccctggaaacagatatgtctgcctttgtgggtttcctgaagcgcctgctagtggcagtgccacgatctggagttcaacaggcggcagtgcaggcatgtctacgcttgcaaagattcggattcaagtaca

SEQ ID NO: 369 - DNA, 207 bp, Drosophila suzukii
gtttttccaggaaacacatttattttatttaaattaacccacacaaaggaaaatcgcttatttgacatgtcaaatgtaaattatggttcaggcatattagggagatctcttggaatataccgccttggaatatttttacctgcggtttatttctgcgaaccagctacggtcacctaaggttgaccaactaatagaaaatttgcaaat

SEQ ID NO: 370 - DNA, 311 bp, Drosophila suzukii
agccccagcgataggaaacacggcacgttgttatgccgtcaaaccggcggcaccagcgagcaagaagaaaaagctgggcaagctgggacccatcatggagaagaaaatcattcccgtggagacggatgccaacaaactggtgaactatgtgtgcggtagcaactacctgaaaacaggacaggatgtcaagtttcaattcattggccaagaaatgtggagcggaactggtttgattaagctgctcatcgggcctatcctgatggtagcatcctcatccgcccaaggcaactcttcaaagaacgttgtctgct

SEQ ID NO: 371 - DNA, 215 bp, Drosophila suzukii
tctcgactgggagtatcccggccagcgtcacagcctggaaaacgcggatcaatcgaactatataacgtttttaaaggagctgaaggaggggctggaaccctttggtttcctgctcaccgcggctgtgggatccgcccagttctccgctgaaatatcctacgacattccggccatggtcccatacttggacctcatcaatgtgatggcctatgacc

SEQ ID NO: 372 - DNA, 201 bp, Drosophila suzukii
atgtgatggcctatgacctccacggaccttgggaccaggttgtaggcatcaatgctcctctctatgccgctgaaagtgattccaacgacgccaccggtcggcagcagcagctcaatgtggacgccatagtcaagtattggctgcaagcaggtgctccgccagaaaaactgatcgtaggagttcccttctacggacgcacct

SEQ ID NO: 373 - DNA, 220 bp, Drosophila suzukii
ttctacggacgcaccttcaccttgaccaccgcagagggcaaccagccaggatctccgcatataggaaggggaatagcgggcaaatactcccgtgaaccgggtgtccttggatacaacgaactctgcgagctgatgcagcaggaggagtggaccaagaagtgggagccgacacagcaggtgccctacgccttcaggcagcgacagtgggtgggctacgagg

SEQ ID NO: 374 - DNA, 240 bp, Drosophila suzukii
ggcgcagtatgtgatggaccaccatctgggtggcattatggtctggtcccttgaatcggatgacttcaaaggcacctgtggtcagcagacctatcccctcctgcacgaaatcaaccgagtgctcttcggcagtgatacacccactggcttgacccccgaatccagcaaggacaagcccagtgaggggttcagttgttcggctgatgcccctgaaggatatgttcgtgatccggacaactg

SEQ ID NO: 375 - DNA, 228 bp, Drosophila suzukii
acatggatccctccggcacctttgtgcgccacgaggccaaggccattggatcgggcagcgagggcgcccagcagaacctgcaggacaacttcaccaaccagatgaccctcaacgaagccatcgacctctcgctgaacaccctgaagcaggtcatggaggagaagctgaactccaccaacgtggaggtcatgaccatgaccaaggagaaggagttctacatgttcacca

SEQ ID NO: 376 - DNA, 338 bp, Drosophila suzukii
cagcagcaacagccaccacagcagcggcataaacaagcagcccatgggcgtgatccaaatgccaggaggaggaggtggagcaggagcaggacctggaccaccccatcccctttgcaaccgcatcaccttgggggagtgcagcctgaatggaatggacagctttgccacgccggtagcccctcctttggcatccaacacaccgcaaacgcctcagggaatgggtcccagttccaactccacttccacttccatgtccacttcctcctctgccctgggcatggagttgggcctaggaatgggtgcccatacccagatgagtcagtgcgcccactgctgcc

SEQ ID NO: 377 - DNA, 269 bp, Drosophila suzukii
acagaaacagaaccagaacggaaataagcagcttttgactaacggcaaaatggaggccatagtagcctatacgtgtgtgctgaactacatttgtgtatgtgctgcttctgccgccagtgagctaatcgcaaatcgctcgacgcccacggacgaatcggtggcaaagccccatccccccggcgaccttccatcgaattcgacccctgccacgccccccaaattcaccagcccctttcgggaggcggatgtcgcggagggggaggcggagg

SEQ ID NO: 378 - DNA, 519 bp, Drosophila suzukii
ccaccagggacacggtcacccgcgagaccaccaacataaagaatattttcgaggctgagctgctggagacgcgtcgtcttctggatgagacggcacgggatcgtgcccgtggcgagatcgacatcaagcgtctttgggaggagaccgaggagctgaagtgccggctggacaagaaaacaaaggagtgtagcaccgctgagggcaatgctcgaatgttcgagtcgcgtgccaacgagctgggcaataaattcaaccaggccaatgctgaccgcaagaaagttaccgacgaactgaacgaagcagtcaaggagttggaacgcctacgaaagcagttagacgagacacgtaagaacctggaggcggagacactatcgcgcgttgatctggagaacaccatccagagtctgcgcgaggaactctcgttcaaggatcaaatccactcgcaggagatcaacgagtcgcgccgcatccgccaaacggagtacagcgagatcgacggacgcctcagctccgagtacg

SEQ ID NO: 379 - DNA, 355 bp, Drosophila suzukii
cagtacgaggagcagatgcgcattaatcgcgatgacatcgaatcgctgtacgaggacaagatccgtcgcctgcaagaggccgctgcacgcacatccaattcgacgcacaagtccatcgaagagttgcgctctactcgcgtccgtatcgacggtctaaatgccaagatcaatgatctggagcagaccaatgccattcttaatgtacgcatacgcgagctggagcagcaactggacaacgatcgtgagcgccacggccaggaggtggcccatctcgagaaggagcttatcagactgcgggaagagatgacgcagcaactacaggagtaccaggacctgatggacatcaaggtctccc

SEQ ID NO: 380 - DNA, 246 bp, Drosophila suzukii
ccctggatttggaaatcgctgcctacgacaagctgctggtcggcgaggaggctcgcttgaacatcgccccagcctccaacactgccaccgtgcagtctttcagccagtcgctgcgcacctccacccgtgccacgccctcacgtcgcacgccctccggcgccatgaagcgcaagcgcgctgtggtcgaggagtctgaagatcgcagcgtgtccgactactatgtgtcggccagtgccaagggcaacg

SEQ ID NO: 381 - DNA, 317 bp, Drosophila suzukii
gcatctggcaggattacatttactttttacgtggcgttgaagccgttggtaattatgcggagaaccagaagatcacagcagtacgccgtgtctatcaaaaagcggtagtcacacccattgttggtattgagcagctatggaaggattacatcgctttcgagcaaaacatcaatccaattatatcggagaagatgagtctggaacgatccaaggactacatgaacgctcgccgtgtggccaaggaactggaataccacactaaaggccttaatcgcaacttgcccgccgttccgcccactctcaccaaggaggaggtg

SEQ ID NO: 382 - DNA, 239 bp, Drosophila suzukii
gccagacattgatcccacactggtctatgtgcagtacatgaagtttgcccgtcgtgctgagggcataaagtcggcgcgtggcatctttaagaaggcacgcgaggacgttcggtcgcgctatcacatctttgtggccgccgctttgatggagtactattgttccaaggacaaggaaatcgcctttcgaatctttgaattgggactaaagcgatttggaggtagtccagagtacgtgatgt

SEQ ID NO: 383 - DNA, 201 bp, Drosophila suzukii
cctgcaccagcaccgagctgaagtccataggatatgccgagaatgtgggcattatcctaaacaaggtaggcgggggagttcaaacacaaaacaccggagatgtcgaggcagatagcgaggctgctcccccgctaccacgtccggatttttctcagatgattccgttcaagccgcgaccatgcgctcatcctggtgcccatc

SEQ ID NO: 384 - DNA, 242 bp, Drosophila suzukii
cgcaaccgaatggagacaatgaactgtcgccaaagatctttgatttggctaagtcagtgcactggatcgtggacacaagtacgtatacgggtgttcagcatagtgtaacggccataccaccgcgccggcgacgtctgttgcctggtggcgatgacagtgacgacgaacttcagaccgccgtgccgcccacccacgatatttatcgactgcggcagctcaagcgttttgctaagtcaaattaa

SEQ ID NO: 385 - DNA, 259 bp, Drosophila suzukii
caacagtacggtcagtctggctccaccacccagatgcaccaaggtcgcctgactggcggaggtaatggtgggggcatggctgcatcctgtccctcatcaccttcgcatgctggtaactggagctccactcccaactccggccagatgatgaccaacggcaacatgtggcagtacagccaacccatccagaaccaccaggcgcagtatccccagcagcaccattaccagcagcagcagagtcatcaccaccagcaacagc

SEQ ID NO: 386 - DNA, 241 bp, Drosophila suzukii
cccactccaccaaggtggcccgaagtaattccctgctaaaaccgaaccagactggcgtcataggatcgggaagtggtactacgacgggactagcatccattaattcggcgggcgccatgcagcagggatcattgtccagcagctgtgctggggatagttccagtaacaacggcagctggggcaagcacttttaccagccctacgacgtctgccccctgagtttggacgagctcaattgcta

SEQ ID NO: 387 - DNA, 300 bp, Drosophila suzukii
tcaaacaggtgtgccaatcggctcgccagggctcccaggacgatttcctgggatccgtgaacattccggtatccgaaatcccatccaccggactggatgcttggttcaagctggaggcacgcagtcatcggagcaccgttcagggcagaatccggcttaagatgtggctctcaactcgcgaggaccggagcaccgtcagcgaggagaaccacgagcagcagatccacaaggtcgagcagcttcaaagggtcttcatgcagcacgaggtgaccacgcacgaaccttcgtggacctggtgtg

SEQ ID NO: 388 - DNA, 255 bp, Drosophila suzukii
tccatctggcctggtcacctgactccctgcccgcgaatcaagctattgttcctttgttggagtacctggattgccacctggctgccctgaacagtgccctgctcaccaagaacttcaaccgttcgctgcggttcatttggaaaactgtcctgggcgaaatgtcgcggcaaatggaaaccggcgatgagacggacaagccaacgcatttccacaaacgtctctatgaggcactgcagctgctcatcgatttctttc

SEQ ID NO: 389 - DNA, 417 bp, Drosophila suzukii
gggcctacttcaaccacgattcgctgtgtgtggaggtcctgcatgcccgagatgtggtgcccttggatccgaatggtttcagcgatcccttcgtcgttatcgaactgctgccccgcaggattttccttcactgcatggagcagcagaccaatgtgcacaagcgcactctgaaccccgttttcgacgaatgcttcgagttctcggtgaccctagagcagtgtttaactgagggtgccatgatctgcttcacggtgatggaccacgatgttctgacggcgaatgactttggtggggaggcctatttggctctgggtaatattcccggagtggctgactacagcacgagtgtggacaacttccatggtctgaagcaaatcgaactgcccctcatggagcagaaggataaatgcaatccca

SEQ ID NO: 390 - DNA, 394 bp, Drosophila suzukii
atgtttacattcgtaaagtcaaggtattgaagaagccgcgtttcgatgtctcaaagctcttggagttgcatggtgatggtggcggcaaatctgtcgatgccgtcgtttccaccgagggagctgtaattgaccgccccgaaggttatgagcctccagtgcaggaagccgtctaaagtgaatgtgaaatgcatatttttcattgtaatgtaatgatgaaatacattactctacatattgcataaactattttagaggggcattgtgttaattagtgggccttgggaaagtcttacatattttaggtatcttgttcgtgtccacaattttttatctggtatgcgtggttttccccccaagagacccgtgttaaaatcgaaggaagattttacgaaag

SEQ ID NO: 391 - DNA, 375 bp, Drosophila suzukii
aggaagattttacgaaagaaaggtatgtcgaatagtgctgaggagttacgaacagagataaggacctaaataatgtgagcagtaacttaacaaatttgaatataccgtaatgtgtgtctgtctgctattatgtttatgaaatggtcatcttatgacatagacagtgttcagcccacggaacacctctattgcaccgccctccctcctattctgcgcccacagctcccaacgtcttctgaagcctacaacgctctctcaagtgtatagtttatgtaagagtaagataaatcgacagatcaagtaaataaacgtcatcttcgcaaattttcggtactttctttctttctaattacagaattatcgtgtgaagaaata

SEQ ID NO: 392 - DNA, 420 bp, Drosophila suzukii
aggcgggtcacaatggcgctgtcactggtttgctgaaggtgggcaccaaggatctctacttatttgacgagtccgggcagacacgcaaggtggagcaggctccatccattctggacttttatatccacgagtcgcgtcaacgcgccggcttgggaaagcgtctcttccagacgatgctgaacgaggagcagtggacgccacttaagtgctccgttgatcgtccatccgaaaagctactgggtttcctgagcaaacattacggcttacagcgaatcattccgcaggcaaacaactttgtactctacgagggattcttcaacgatgtagcccctgcgaatggacacggtaatgcccatggacacgcccagtcgccgcagcgcacccaaaatggcctgcacattacaaacagtcctaacacac

SEQ ID NO: 393 - DNA, 250 bp, Drosophila suzukii
catggaacacgatccggataccttcaggaacaactcaatcgcctgtctgagggccaaagcgcaggagcaccaggcgcgcctcctgaacaacggaggactcttcctgcaggtgcgcaggttcgcacagggccaagtgcaggtccaggatccaagtgatatgttcaagctcaaggaggagcacaacaacaacaccccacagcctatttctgcctcccattcgggttctcaagccaatgtgaaaatggagctg

SEQ ID NO: 394 - DNA, 211 bp, Drosophila suzukii
atgtgaaaatggagctgactgccaacggatcgctgaaaaactgcgaggaggtctaacaggagccccaaggaacccacatttctcagtttccccagttgcaagtgctacgaacccaagacacaccaaaccaaatataagaaaaccttttttttactagaccctaggaacaatactcttggcataagcataagatctgtaatcgaatatttta

SEQ ID NO: 395 - DNA, 260 bp, Drosophila suzukii
tgacatgggctgagactgcagcgcaatcgtcgccagtgattggcagcaacaacaatgccagccagctgagcgctccagcggcagcagcgtctccagcagcacctgccaagcaagcaggggacacgccgccacccgctgtggcgcctccgcccaaggtcatcgccaagacgcgtctgtgctggtgccttgctgccgcgtttagatgccaatggcaaggaattgcccatctgcgccgagtgcaaatatacatgctcttcctg

SEQ ID NO: 396 - DNA, 210 bp, Drosophila suzukii
cctaaaatctccccacaaaccctcggcttgcatctatcaaatcgcgcgccttgaactcgtgctgcaactatttaaacttctgtgtctatatatcatcgaagtgtttccaaaaatctcggctctcgactcttaatgtctgaactaatcaaaaactaaactaaacttcgcccaagccagcaagagctataaaagaactatctatgaatattt

SEQ ID NO: 397 - DNA, 258 bp, Drosophila suzukii
tcctgagctgctgcagccggggcaatcgttcgatcaagtccgccggtgagtcctcgataaaccgcgattccggcggaagttccggtcattacacccatcgcagtgagccgtgctacaagagagagcgccaaagggatgcggccggaagtggggctccggcgagcggaacaatcaaaaactgttgcaccctggtggcggccacccgaagggacagtggttcctccacccagcacagtgcgaattcctactgtggctatg

SEQ ID NO: 398 - DNA, 241 bp, Drosophila suzukii
  misc_feature (229)..(229): n is a, c, g, or t
attcctactgtggctatgtcactccggctggggaatactcgggaatgagtggaggtcgcaacacggagtgtttggattgccgttgcaaacaggacaccggaatgggttccgattatctgctcaactttacgcccactccagaggttccggaggccttccaggacgactacacacccactcccccatcacctaggctcaagacccagacgccccgatattcgagctcatncagccagcagct

SEQ ID NO: 399 - DNA, 225 bp, Drosophila suzukii
gcatccgcttcaagaacaggaatcgactgccagttcaaggagaacaagaacgaatgctaagtatcaaaaggaaaaatctgatctgtgaaaactcctacgggcagcgccttaaaatcgctgcctgccaatcgggagtgggcgtggcatttttggattgccgttgcaaacaggacactggaatgggttccgattatctgctcaactttacgcccactccggaggttc

SEQ ID NO: 400 - DNA, 363 bp, Drosophila suzukii
gatactcgctggccctgcactatgacgagcacatgctgctgaacccgcaaacgaacgaatggtccaccaccgcggacaaggacgaagcggcgaatgaggccgcggggttgggatcggcagcaggagcaggcagtcatcgaagtcggccaaagccggcgaccctggacgaaagtcacgtcaagacggaggcgggccaggccaagcatgactttggactagtggaggtgctgcggtggccctatgagaacgaccttctcctgcagtgcatcgatcgtgagatgctgccggagtttctaatggatctactcggcgcggagacggtcagtttgtcggacggcgaggggacacgggtgtacgccaagc

SEQ ID NO: 401 - DNA, 271 bp, Drosophila suzukii
gaaaagtatgccaaggccttcgaaccccttaacgaattcagcgaggcctgcaaggacggctgccagccgaattgccggcacaacttccaaccgcagctcatcgaggaatacgtcctcgaaacggagcgtgaggccagtgaaggtcggcgggcgttgtaccacatcaaactgtccatcttccagcggccctccgatgccgaatatctcggcgaactgtatgtggaccgagactaccgggagggcgagcgcaatggcgagtcgtgccgctttg

SEQ ID NO: 402 - DNA, 264 bp, Drosophila suzukii
tgacgacgcccacgttgaccccaaccacgacgcgcagcatcgaggattcctttttccagataatttcggatacgcaaaatgatcgtggagctggctgcgcgggattcgccgtgcccctggtgctgcccaatgctgcgaacggaggaaacgagtccaatggcaatggcatcgccgcgattccctgccagcagcagccgtacgatgtgagtctggtggcaggaagcgattccgaggactccaatgcctcgtacaacgatacgcaga

SEQ ID NO: 403 - DNA, 233 bp, Drosophila suzukii
aggaggagcagaagcgggctctgcgccgggagcggaacaagcaggcggcggcccgctgccggaagccatgcggaaggagatcgaggcgctgacgaacagcaagaaccagctggaatacctgctggccgcccatcggcccacctgccacaagatccgctcggatctgctgagtgtgaccacctgcaatgggctgattgctccggctggactcctgagtgccggcagcagtggca

SEQ ID NO: 404 - DNA, 255 bp, Drosophila suzukii
gatctctgcagacgccgataacgagcacggcgcccggaggatttggtagtgcctttccggtgaccaccaatggaggaggaaacggtagcaccagcatgaacagtcccacgctgaatgccctgaacaaggtgcccaaggagcggcccaacacgctggcctttcagcgacccctgggcatgcacctgaccctggccaacagcaaggcgcagcacggtggccccacgcagatccagggagtgcccatccagacgccct

SEQ ID NO: 405 - DNA, 231 bp, Drosophila suzukii
cctttcggttaggatgggttgcgtagtactcaggggaaacgaaaaactaatctttgtagaatttgaagacatttcacttggaagtttcatatgataactggaaaagaaatactttaatacacacaaattgttactcaaatttaaaatcaaagattactttccgttcctttagttctttgccaatgtacaacgacccgtccgactttctgtatatagaaatcacatctgcat

SEQ ID NO: 406 - DNA, 203 bp, Drosophila suzukii
ataacatcaatttacattttaaaagttagaactttttttaaaagtcggttacttgctgccctacatccgttttccaacactgaaccaccactgacgtggcccagagttgcaagcgtgtgcgtgtgagcgtatcgcaaatctgtgactgtgtgcgtgcttagaaagcgccggcaaaaaaatcagaaagcagcagccacatattc

SEQ ID NO: 407 - DNA, 228 bp, Drosophila suzukii
gcatgctctcggccaccgcctcgctgggtctgatacttctgtgggacgtggatggcggtctgaccatgatcgacaagtacttgtactccacggacgacaacatcaaatccggcgctctgctggcctgtggaatcgtcaactgtggcatccgtaacgaagtggatccggcccatgcactgctctccgactacattgataaccagaacacgtgcatgcgcgttggcgcca

SEQ ID NO: 408 - DNA, 585 bp, Drosophila suzukii
tgctgaaggattgccgccaggtgaagaagcccgttgctggagacaatgacttgaaaaatatgatggccaaatccgaggagtttcctctggagtttggtgtgcaaagtgtccgggtgaagaggcaatctcctctgcggctggccaggatcaacgaggaggtggcctccgcctatccggtgatacacgaacgcaccctgggtctttatctgcagtatctggagcacaagtgccattgggggaactctgtggagaagcccatatacaggccactctccctctgtggatttgtgcagcgcctcctggagaagcgctgcgccagcttctttgcccgcaacgacaagttcctgctgctgagcggtgagacgggggccagtggctttgaatcagtaggcacgccggaggagaaggcacccctggtgctggccgacgttctaagctacgacgacattaagttgtccgccctgctctccgtgagctcacacacggagttcgtcaacgagggcgagcggaccaactgcggtcacgttgacttgaacaccaagacgctggagcggacaggcgttatcgtgggcatgattggagccc

SEQ ID NO: 409 - DNA, 249 bp, Drosophila suzukii
tggagttccaggacattgtcattgcacgccagcagaatacgcgggaaaacggctatggaatggccttggatgagtcgtctggaacgcgaaaagaggactaccggcgcctgtggcgcggattctatgccacgcgggatctcatccacggcgaggctgtcattgacaacagacgcttcggaccctcgaggaacaagcaggacgtctttgacaacctggtgatgaagcggcgctacgccatcagcttcgaca

SEQ ID NO: 410 - DNA, 228 bp, Drosophila suzukii
ccgatgcggacgatgtgccgtataatccgaaaaacctgccgcttggatgggacggcaaacctatcccttactggctgtacaagttgcacggactgaacatcagctacaactgcgagatctgcggaaatttcacctacaagggtcccaaggccttccaacgccactttgccgagtggcgacacgcgcatggcatgcgctgtctgggcatcccgaacaccgcccatttcg

SEQ ID NO: 411 - DNA, 315 bp, Drosophila suzukii
agatctttgaggtgcacaacaatttcgctggccaggccaagggtccggcctatttgccgcctcagggtcagagttccagtggtcagggtcatgacgacagcttggatctgtccttcctgaactttgccgatgctccagctccaagtcctgctgctgctccgatttccgtgcccttcccttcgagctatcaacatgacttccagcgaaaggctccggcctcgtcctctgggggttacagtggccaggcctatctgccacccaccagcgctgccacgccctttgtccagcagcagcaacaagtggtgcagcagcaac

SEQ ID NO: 412 - DNA, 266 bp, Drosophila suzukii
tcctgctcccgctccagtgcgtgttgcagctcctgctcccgctcccgtccatgtggccggacccgctcccatcgccatttccctgccagctccggcacccacccaggtgacccacatccactccctgcggagctacatgaacaccgtgcaacccttcgcccgctatgcgcagccagtggccgtacgtcagcaacaccagcacgtcgtgcagcagcaacatcagcgtgtgcagcagcaacaccaccatgtgcagcagcaacaccagc

SEQ ID NO: 413 - DNA, 233 bp, Drosophila suzukii
cttcaaggtgctggagcaattggatcaggctggcgtcaagacgatcaagatcctcggggccaccaatgagcagccacagggacgccaccaggtcgtcaaggtggtgacccagaatgcgcagagcggtgccgagagtcatgtgcagacggtgaagatctacgatgaagtgcagcaggtccagcagccactgcgcctgcagccactgagcggtggcaacaacgcctacttgccac

SEQ ID NO: 414 - DNA, 275 bp, Drosophila suzukii
ataaaagataaaggtgttctcgcgttacctcataattaaccgtttgtaatcgttataacaatgcggcgcacaccgaaacttcaccttgtgggccgagcctactcggagatgtcgcccctgaatccggatcctctgccggaatccccgaccacaagcaatgctggacaggatcggcggggcgagcagggcggctatggcagcatgttcccctttggactacttcgcggctcctttggccgaggtggtaatgccaaccaggcggccttcaagacgga

SEQ ID NO: 415 - DNA, 216 bp, Drosophila suzukii
tgttgcagtacatcgataacaatgatatttccggtctgcgcgctattttggatagccgacatctcaccatcgatgatcgggatgagaatgccaccacagtgttgatggttgtggccggacgtggtctgactgcttttgtccgggaattcctggcccgtggtgccgatgtccaagcggaggacttggataactggactgcactgctgtgtgcctccc

SEQ ID NO: 416 - DNA, 282 bp, Drosophila suzukii
cgcgccaatgggcggaacccccgatccgaacaagcggtctgcttttcattgtctgctttcatctggcactgcttattgggacgattgtgggactaagcaccaagtcggcggtggtaggcgcctcctcgggcgtgggattcctgctgctggcatatctgctcatggcggctgttaggtactgcaactatcagatggacatgcaatgggcctactcagtgcaacatggcctggagaagaggattacaaggttgcgcctgatactacaggtggccttttgccatc

SEQ ID NO: 417 - DNA, 423 bp, Drosophila suzukii
tggccttttgccatcccccaggaccacagtcggattcacaggccaagcccgtgcggtttcactttgctgaggcgaatagtgcttcgccaacgggcgatggagcagtggcccatatgctggcctccctactcgatgccatcgaatctcactacggatggctggccacgcggttgtatcgagccttccggcccaagtgcttgaaggtggatgtgggctggcgatggcgtcgcatgtgctgcattcccatcgtgttgatcttcgaactggcacttgttaccctaatcactggcatctccctcatcgtggtctacttcacgtttgccgataaggaagatccgcaggagcaaaaggagcagaaggaacagaaggaacagatcctagtgggtctctatgtaattgccgcagtgatgggcacgctgatct

SEQ ID NO: 418 - DNA, 236 bp, Drosophila suzukii
cgagtatcctgccaatgagctgcgctctaggaatctcagctcgagcacagagcccgttactccactgattaactcgccaagtgattcatttggtgatgacatcttgcaaacaaagctgaccgacttaaccgtggagggagtcatcagcctgttggagcgcattgaggacatgaagccggcgttggccaaactggcgcccgtactccgcgagaacgctatcaatggacgtgtgctga

SEQ ID NO: 419 - DNA, 330 bp, Drosophila suzukii
cctacgacgacaccaagctgtgagggtccctaacccgcggatgcacccgtacaactgcgtacctagttaagctgcatggggttgtgtcgttcttaacttttaaagtctgacaaaactgaaccatttcgaacgctggaccaatgtctgagccaaatgaaaccagaccaaaaccaatagcatatagcatatcatccgaaacatgattttacgtattatttgatttactcttgctttggcttggctttgatccggtcagtattatctactattactaatatttgagttctgcgattactaaatcattccaattgttatatgccgaagattagt

SEQ ID NO: 420 - DNA, 362 bp, Drosophila suzukii
ctatgtctatccctagcgtgagatgaagcatcaaataaaggagatatcttatgaacaactcgttacctcttgcattttattcagcttctatctgtgtttatgttccgcctttaacctctgttctgagttaattggttgcttttattcacctggttactataacttcaccgggttagcacctcttgtgtctggcaatccccccagatccctgactaaatctccctcatccgtatgatttttagaactcgactcgccgagtgccggagccgcaatgaccacgccattgctcggctcctccggcaccagctccgtgcaacagccgacaggtcgggattccattttgaagcagcagggaagcgtca

SEQ ID NO: 421 - DNA, 1441 bp, Drosophila suzukii
acgcttagttacaaattagattataatgcaactagctaatagcaagaggactttgtgggaactctgccttttgggttacacaatgatatagtcgtatactcggtacgctaagaaaaagacactttgttagcaagtcttggttgtaagccacattagagtttactacctgttataaatgtatgatgcatgtgcaaatgtgtatttattaattgtataaagaaagtgagaatacattgcgcgagattagatgacttaaacgattaatacagccgtttagtaacagccttacctttgggcaagagatttgaaaatacatataattgagaaaacaaaatgttggacccattatatgcaattggtataggaacttgtgacaattaaatcaattacaatctatgattccttcattgagctcaaggaatgcattatttggcatggctatttggaataaaaaaatgtttgagaatggttattgctggtgagctgccgcacgagcaatggcaagagccggttgcagtgccctgtagagttgaacggccacggcggtgctaggcagggtgttgtagatctcctgcatggctaacatcacgttcgactggtgctgtgtcaaattcattgggtcaaatttcgggtcctgccagaaggcccccttcagttggctttccaagcgaacctgtgtgcccgcatcgtgggtggcagtcctgcgttccgtttgggttgctgcattcttgtaaagcgtggccgtgtccacttcctccgttggctccaagccctgttcgagcttctccttttttagcttgagtatacgctgcgatggcttggccgtgctctggatctgcttcaggcgcgccacatcgatgcccagcaggcgcagcagcttcccagtagccttgggcactccttctaggccccatttagccaaatcgattcgggttccgggcgtggagttgaactcgtagaccacattcatgttgttgcaaatgggcgagggattctcgaagcaaccttggtttctaaaggagtcattcacaggcagtttgcagatggtgtccaccacgtggaactcttccgccacctccttgttggcctttttctcgaacagttccagcaccaactccgcccgtgccacggccagattacgcttgtcagccttggacagatttttagtattcagttcatcctgcggcggcggacgctcgctgagattagagaacttaactggccgaatggacttctcatcggggcaaactgggacgtagtccaattcttcatctggcttttcggtcttaatgagatgcttgtgcccacgacggtcgccacgatgcttctccttcgcgccctcgtcctccgaactgccgcttcgttttcgcttcctggactcatcctgatctctgttcgagcgatgggagcgatccttcttgtgcttctttttcttcttctt

SEQ ID NO: 422 - DNA, 435 bp, Drosophila suzukii
agccggtgtacaagtccaccactaggccggagtatagaccccgcgggcactccatgtccccgccagactacgagcgctatcactactcgcgctcacccatgggcccgggggctcctctggatcaccgccggcccccgcttgatccctatgaccgctacggtcctccgcatatgcatccgcatgccgtacatccacgggattaccggccaatgcaccatgactatccacatccgccacgcggtccacctctgcatcgcggcggccatcctcatcacctccatggccacgcaccaccccatcagtacgctcctatgagaccactggcaccacgtccacatgctccttacgaaaagcccgaaagcaaaaaggacaagttccccaactatttgcaccacgtgcagcccgaggacgatcccctttctacgcgcacactgt

SEQ ID NO: 423 - DNA, 534 bp, Drosophila suzukii
ctcagctggagcgagagttcgatcgtttcggcgcgattaagaagatcgaataccaaaagggagagccatacgcttacattcagtacgagaccgtggaggcggccacggcggcggtaaaagagatgcgaggatttcccctgggcggaccggagcgtcgtcttcgcacggacttcgcagaactaccgggcgccacaccggcagcaccatttaagggctccaagccgccatatgacgaaagtgcgttggagtaccggcgtccggaatatgatccgtactacgaggagtcggcgtcctacgcaccgcgaggtggctactccccgtatccacccaggggtggctaccgcggacgtggtggctatcgcggaagaggacgcggcatgtaccactaccacaatgatgttcacaggccgccgcatcctgggtccttgggtgggtcctcctcgtcggtgccgcctcctggaggagtggatgatgagtggcgacgtccacctggagaatcttacgacaggggagctcgctccagctctcgggaac

SEQ ID NO: 424 - DNA, 351 bp, Drosophila suzukii
gggctcgctctcccggatccgattccgacacgtcgactcgccgcaacgacgctcttggatcagccagtacagttccagaggtggcccgcaagtgcagtacagtgtggaccggagctctgatccttaagagctccctgttcccagccaagttccatctgacggacggcgacacagatattgtcgagtcgctgatgcgcgacgaagagggcaaacacaacctacgcatcacccagcgactgcgtttggatccgccaaagctggacgatgtgcaaaagcgaattgcatcctcctcgtcgcacgctatcttcatgggcttggccggctccacaaatgacaccaattgcgacgatg

SEQ ID NO: 425 - DNA, 219 bp, Drosophila suzukii
agctggcggtgaccagtgctgcccaacaacgacaacaggagctgctcaagcaggtggtggagcagcagtttgttcccaaggagccgcctccggagttcgagtttattgccgatccaccctccatttcagccctggatttggatattgtcaagctcaccgcccaatttgtggcccgtaatggtcggcagttcctgaccaaccttatgagccgggagcagc

SEQ ID NO: 426 - DNA, 465 bp, Drosophila suzukii
ttgtggtggtggagacggttgactatcagcccttcgagtccggcaacttcccgccgcccacaaatccggacgaggtaggtgcccgagtgcttatggaggagcgtttaatggacgaggagggcgacacagagatgcagatcgagtcggatgatgagggtgacacccaggtgaccagccatctggaaagcggactgaagctgtcgcaaatggagaaccgcgttggcattcagatgaagaacgtgtcgtcctacggtcagccgacgggcgccaagagggacaacacccaggtgcaggacatggacgaggcctccagcgacgaggacactccgacgaccaagctgcagccagcggtggcgcccatgctgccgcccactcacgacaaggtggtggtcaagaagtatgatcccaaggcgacgcaaccaaaggcggcacccatgccgacagacgagtatctcatctcgccga

SEQ ID NO: 427 - DNA, 228 bp, Drosophila suzukii
agccgtcaaccaagtcgcaacacagtcactctagccagagtcagcaccaccaaggtggaggtggtcatcacggacaccacaatatgcaccatcaccatccgccgcatcagcaggcaccgccgcaccaatcgcatcatcaccatccgccgcagccgccacagccggtgatgcagctgatgtcactgcgtccacaaatgatgcaacccccatttggagctggtggtggag

SEQ ID NO: 428 - DNA, 234 bp, Drosophila suzukii
atataatggaggaggagccaccatccaaaaagatgcgaagcgaagacaacctaattccagaggcagagttcattgcaactcacaagagccctgtaacaattcaggttttggtgcccaattcggacaaatccgagtggaagcttaatggccaaatgatagccgttaccatggcactctccgaaccgattactaatcttaaaacgaagctgcaggatgaaactggcatgccaccgg

SEQ ID NO: 429 - DNA, 240 bp, Drosophila suzukii
acccgcaccaccaccaccatcatccgcaccacccggcaacggcctaccatcatcatccgcacatgggaacctacgggggagtctatcacgccgaggcggccatcgaactcaaggaggatcagccgctttttagctttcaggaaccggtggactacagccaggtgacaggccaggtgaatcccccagcgaatactcccaatccgcccgcatccaaatcggcgacgcccccaccgcccaaga

SEQ ID NO: 430 - DNA, 241 bp, Drosophila suzukii
gtgcacgagaacaatgccgaggctctgaaggtcatctacgggtctctggtgttggtgaacaaggtgttcttctcgctgaactcccaggatttgccagagttcttcgaggacaacatgaacacgtggatgggggcgtttattcagcagttggccgcggatgttccatcgctgcgcactggcgatgatgaggatgcgggggttctggagcatctgcgtacgcaggtctgcgagaacatttgcc

SEQ ID NO: 431 - DNA, 219 bp, Drosophila suzukii
ggaggtcaaaggatacggctatttatctagtcacttcatgggcctctcggggtggaacccaaaagcatggtatcacacagacctcggagctggtgccactgccggaattttgcgctcagcagattattccagaactggagcgacccaacattaacgaaatacccgttcttaaggcagctgccattaagtacgtaatggtattccgcagcattttgggtc

SEQ ID NO: 432 - DNA, 261 bp, Drosophila suzukii
gcagcattttgggtccccaggttctggccaactgtctgccgcaactcatcagacatcttcccgccgaaagcccagtggtacacagctatgctgcctgctctgtggagaagatcctcaccatgaaagatgctagcaatgcggtagtgtttggtcctcaagtgcttggacctcacgcaactcaactcatcagcggattgtttgcaaccctctcgctgccgggatccggcgagaacgagtatgtaatgaaagctatcatgagaa

SEQ ID NO: 433 - DNA, 201 bp, Drosophila suzukii
aatttatgccctacgtctttcaaatgctttcagtgctgttggaagttcgggagggctctggttccataccggaaccatattgggctctgttcccttgcttgttgtctccagctctttgggaccgtacgggcaatgttacacccttgattcggctaatctcagctttcatcaagcagggttcagctcagattcaagccttgg

SEQ ID NO: 434 - DNA, 240 bp, Drosophila suzukii
aacaggatcgcaaaatggtagctgtgggtgccacaaaactgctcactgaaacgccggaaatgttgcagccacagtacgcggctttctggccaagactgctacactccctaatagatcttttcgagcggccacctgagaaattaaagggtctcgaaataggagagtctgccggagttgccgaggatcccgatgcgggttatcaagtggcctttgcccaactcactcatgcccagcccaacc

SEQ ID NO: 435 - DNA, 422 bp, Drosophila suzukii
ttatttgtgcccgtcattccccggtagcgacaaacatcttatcgttttgccttaactcagtctcctgaccgaataaattaccatgttgaacaactacaactgcctggcacagcccctgtggcagaatggaccagctcccggcgagttctataacttcacgggcgggcaggcgccaatccagcagctgccccgtgaactgaccacagcgggtccctatggaaccaaacacagcacagctgccatcactacgggctcctccgttttgggcattcgctacgacggcggcgtgatgctcgccgccgataccctggtctcctacggatctctggcgcgctaccagaacatcgagcgcgtcttcaagatcaacaagaacatcctgctaggaggcagcggagacttcgccgacatccagtccatcaagc

SEQ ID NO: 436 - DNA, 291 bp, Drosophila suzukii
acagggactttaccgccgtggaggcttccgaattgatccggcatggaggtgaggtgttgttctaccgcgacacccgtaacatttcccagtacacggtgggcgtgtgcagcgccaacggatgcggtgttgagggtcctttccaggttaatgaaaactggacgttcgccgagaccatcaagggatactagagtttgcgatcctaaatgaaagtagtttaggtttagctcggcggttttgtatgcattaaaatcagttcttcaaggatatgtgtctacatgatttattaaaaat

SEQ ID NO: 437 - DNA, 690 bp, Drosophila suzukii
atgagtcgtagaggaggcagaaacaataggcctttatttcatcggcaagcagccgctttgatcaacagtcgggccatgcaaaactttttaagtcggcagcgttttcaaattgttcctccgggaggatttcgcagatcaaggataaatgggtccaggcgatatgcgtctgctagtcaacgcgatcggaattctactagtcgaagcagggggaattcgcgtagaagtcggcgtcgacgggcccgtagatcccaggcggagttgccggaaagaaacattacaatcaacattgatcctatggatctgctctcggctttcgatgcagttatttcatggtgccgtgagctaacttcggtgtcgctacaggtcgaaacaacagaagagaactatggggtagctcagaacgaagaacagaactccaatgatggtactgatgatcaggacactgaagatgccagtgaacaaaatccacgtcagcaagatcaggacatcgatgaaagtgccgatgatcgggagactgatgatgctaatgatcaaaatcctcgacaggaagttcggggctccaatgaaaatactaatgatcaaaatccacgtcgggaattagggcgctccaatgaaaataccaatgatcgaaattcacgtcaggaaggtctgggctccgatgaaaatgccaataatcaagaagaccactaa

SEQ ID NO: 438 - DNA, 227 bp, Drosophila suzukii
agtccatggatttgttcaaggcggaggacgccttcgacatgatcaacgaggtgttgcactcagatatgttggacagcttcctcaacgaaatagacctggagcaggcgcagatgtacaacatgatgcagatggatgaaactcggacacaaccgtccgtggagcaaccaccgcacgtaaagagcgagcactcgtcgccggtgcacattaaggaggagctgcagcagcag

SEQ ID NO: 439 - DNA, 479 bp, Drosophila suzukii
gcagcagcagcagtcgccactgctctacaagccggatccccttatggcctccaactacaatctcccccagcaacaacagcctgcgctgatgaaggcgggtcagcccacagccaccattcaccacatggacgcccagcggttgccgccaaacaccggtgtcttttccccagctttgggcggtagcattgtctaccagtccatttccccgcccacgccgccggcagagtcatcgccccaaaatgtgaatgtcatgttgcccattgtcccagccgccactcctttggccatgaagtcgcatccgcaacccttcatcacatacacccaaccaatggcaccgagtcccggaatcgttatccctgccacaatggtacccctgctgatggaaggaacgacgacgacttccgtggcgagtccaaagacgtctccacctgttgctccatcgccgagcagcactggtagccgggccagcaaggtgcgag

SEQ ID NO: 440 - DNA, 217 bp, Drosophila suzukii
ttctctcttacgacgtggatgggggtgaaggttttggttggcagcaaagctcttggatatggcttttgaacttgctactaatgttcgggtgtctggtaaagctgctggtttacggcgatccgcaacttgatccacagacggatgcctactggcagcacaagcagcgggctgactcccactttgcccaaggacaggctgctcaggcctacgccggtta

SEQ ID NO: 441 - DNA, 210 bp, Drosophila suzukii
tccatcgcctctggctgggccgggtgctgtctcgtcgaacgggaggactgttcagcaatgccaccagccggaagcaggcgctggcatcggcacgagaactggcgctcctttttaaccgactgaatcaactgcagctgactggaaacggaagccgcggagacgggaatggtataatgatggccctctttgctagcaacatggctgaagtgg

SEQ ID NO: 442 - DNA, 350 bp, Drosophila suzukii
ccgggctcgtcaagagtgcagtcgcacccgggctgccgagcaaacgcaggagttgcgttgggcattcagcgcctatggatatcgatactgcagtacgcacgtctttagctacgacttgaacgactccggcgagaaggatggctttttcacacgcctaaggaatccttgtgaccccgctgcccatgtcgtcaagcaataccgcgaacatctgctgtttaaggccattcagtgcttggtgggagccggaaaagcgtcaggcggtgtgcccacctcttcagcgggtagggagacggagcccctgcagcaacagcaacacagcggcactatcgttagcaatgttcttaagtaca

SEQ ID NO: 443 - DNA, 289 bp, Drosophila suzukii
gaaaacgatcatctgcccagggcgctgcatgccgtgcttcgagccaagatgatcctactaaagaacaatggaaacgctctggaaaaaggcctgaagcaatcggtcaacgtgctatgcgacgagtcgagtgcacagctccaagaatgtctgactgtcaataggatcaccaacgccagagccataaagctgactttccaattgctcacctgcgattggctgcttgaaactcgtaccactttgtgggagcttgagcacatgaacatggaagatgatggcttctaccaagtgc

SEQ ID NO: 444 - DNA, 412 bp, Drosophila suzukii
ccagacggatttgaattcgctgcgcagcattgtggaaaatataccgaacgcccaaccgaggatatatttgtacgaagctgtttgtcgcctgatggccggagcatcaccctgtccaacgcaacagcttctggacaggagtctccgatcgcgttacgcccactcgtccattttctgtggcagcaaggatcggcgccatcagaactacgagggaggggagagagagcgcgcgaatgccatgtttgtggcctgcaagtatctaccgaacgcactgctcagctcccctggcgaacgtgctggcatgttggctgaggcggccaagacgctggagaaggtgggtgacaagcgaaagctgaaagaatgctaccagctgatgaaatcactgggcaacggcattggtagcgtgaaaggttaa

SEQ ID NO: 445 - DNA, 324 bp, Drosophila suzukii
cttggaagcgcaagaaccgcgagcatatgcacagaaaacgataatttgtaaagcttatttattatcggttgaataaagcatttcgtgcattatattcaacaattggcacgttaaaatcatatgtgtgtactttcctgtatgtatataaaaggtaatataaataatgacccattatttcttaagctgaagtgtgttgtgcctttccggagggtaattcaatttcagtctgaaatgtgcaacgcaatatggccctaaggtcaacaaattaatgccgaaacaaatgagcacactagcgtcgagtgccccgactatcagctaaccaac

SEQ ID NO: 446 - DNA, 217 bp, Drosophila suzukii
ccgacatgcagttctgcccaaatggtaatcccccctgttacaagagcaaagatgaggacgtggtcatctccggagaggataaaatacggcttaagattgtgggaacccgagtggacgccacaggcatcgtaagtttcatcctcaaaccaagtttttcgcgcctcaaagttacttttcttttagttcgccattggcaccttgatggacgactacttgg

SEQ ID NO: 447 - DNA, 207 bp, Drosophila suzukii
tacggtcacactagcagggaaaccaattttgtttgtcatctcggcattctgcgtttaacttttccaattgttttataggatctttaaaaatggctctggctgaaatctgcaagataaacaatgctccctacatgaagcccaccgtctggtcttcagaggaggtggacgacgatctaaaagtgcttaactgcaatctggccaatccct

SEQ ID NO: 448 - DNA, 615 bp, Drosophila suzukii
aggagcagcagcaggccgctaactagaggttggattaggggaatataagatattctataaaacgaagttagtaattctttgaataaatcaacataataacgtaatagttttctgcttttctcacttagcttacatttaatattggaaagtttgtatttcggggaataaataaacatgataagggagcttatatagtctaagtttcttgctgttccttcttctgttgggagatcatctgcagggtttccttgtgtcgcatttccgctcgtttttgcttgaacgtgcgctttcctttcttggtttctactcgcgtccttcgcaggacaccgcgttccatggcttttcgaagttcctgctcggcatccaaatgcgcgggaatgtgtatctgacggatcatgcgattccgcaccatgaagtgatcaaagggatgttgacctccattgcgatcaatgaaaactgcatggatgagttcgcaggtcatgtgcccatcggctatatcgatgattccggccacggaggtctcattttgcagatctatgagcacggaatggccctgcagcataatgggccagcaatttaaggtgttggacaccatatacttctcccgcgaactga

SEQ ID NO: 449 - DNA, 207 bp, Drosophila suzukii
tggatgtggagagcaccagttcggactcggaactggactacctcacgccgctcaccgagctgagggcccaggagctgaagggcggcgctgaggcaccgcctccgccactagaggccaccaaggaggctccacggagcaaggataagcagtcgcgggacaagctgaaggagcgggagcgacagcgagagcgcaagaagaagaaggaca

SEQ ID NO: 450 - DNA, 270 bp, Drosophila suzukii
gcagcagcgagctggccaagacccaaaaaaccaaaacgggcaagcgacccagcagcggcagcaccagcaaaaaatccaagagacgccgctcctcctcgacctccagctctgaatcttcatcgtcctcatcgtcttcttccagttcggaatcgtctaccgatgatgatgactcctccagcgactcatccgcatccgagtcggattccagcgacaatgaggagtccagcaccagcgaatcggatgagtacgggcgcaagaagaagcggcagg

SEQ ID NO: 451 - DNA, 201 bp, Drosophila suzukii
accaggcgcgcctgaatgccagtggtttggagggacgtggcaagatcaaggatctggatgcggatgtggatgccgatgccgatgcagaactggaggatacctcatcatcggcctccggtcaaggggtctatgcccaggcggcatcggccttcaagccaccgattgacattattaaacggaactatgtggccgccgctcatg

SEQ ID NO: 452 - DNA, 210 bp, Drosophila suzukii
atggcaaacagtacacgatcctccagccggcgggcattggaagtcgggcggcatctgtgatgcaggatattgcatcgcgtgagggcgttgtgggcgtaccgctcgtggccacgcccccaacgacagcggcgggcagtccagtggcagccctaccagcagccggaccttcgactccttcgacaccggcgcccagttattcgccgggtagcc

SEQ ID NO: 453 - DNA, 255 bp, Drosophila suzukii
acagcaactgcatcaacaacaacagcacgaaatctctgagtggcgccccaacgatgccaattatcaaatctgaatacagtcctgtagccagtattaaatcggagtataataagagccccatgcactcgtatctctcgggggatgcggccacgcccgctcccaccgccccctcgtcggcgagtgccgcccaagcgccgcgttccggttcggcgagcggtacagcggcctcaaatggtgagaacaacctgcatgcac

SEQ ID NO: 454 - DNA, 258 bp, Drosophila suzukii
ctccaagacccctgggcttcggcctggtgggacacatcagcggtccgcgaccctatagccgcgaatccacgccggatagcggcggctctcattatatcgaaacgtatcgggatcccagtggatactcaccgcaccccggctatgggatggtggtccaatcggactatccgccagctggataccacggctacggtccagctgcataccaatgcagtaatccatacgccaccgccgtcggacccggtggctatcccacgc

SEQ ID NO: 455 - DNA, 228 bp, Drosophila suzukii
cgccaccgccaccaccgcctggcggggccacgcccggttcctcgggggcctcggtggttcatggcctagacaatgtgtgtggtggtgccggtggtcaattggtgggtggagagcactcagcggcggcctattccacgctcctgccgccgccaccactcccgtcctcgggtggtgctccatctgccggtggtggtgctggtatgtatgggggtggtggtgctgctggcg

SEQ ID NO: 456 - DNA, 236 bp, Drosophila suzukii
tctcgccggacacctcgctgaactgcactcccaacaatgtgactctgtgcgccgcgcagggcagccagctgaagatactccgcaccgatctgggtcagttcaacacgctacaggtgctccatggccacggagactatgtcaacgatgtgtcctgggtctgcgagggtgagctgctggcctcggtcagcgatgacttcacctgccgcttctggacgacggcaggcagcggggagaat

SEQ ID NO: 457 - DNA, 228 bp, Drosophila suzukii
ccgaggatcccaacaaggtgctggtggcggagaaaaaaggcatcattcatctgtacaatgtgaggagcaagcaaacggtcatctccgtggagtcccccaaattcccgctcatgtcggcggattgggccaacagcaatagacttttcatcacctccctagctggcggggatgtgatcacctgggacctgaacagaccctttgtgcccgccgatgtcaagcaggtccacg

SEQ ID NO: 458 - DNA, 249 bp, Drosophila suzukii
tccacgaggattgcggccgagtagttcgatttgcaccaggaagctccgaaatggtcatagccctgattatcgggctaaccttaaaggttttcgcagccaagtccacgcgcgacatcaaggggctggcgataggcaaaatgtactataagatccaggagtaccccaggtgcatcgagtatctgaccagctatctcagggccaaagatgaagcggtggctcacaacctgctagccacttgctacagtaggc

SEQ ID NO: 459 - DNA, 1059 bp, Drosophila suzukii
cttgctacagtaggctgaagactcctgatgtgcagaaggcgctgcagcactggcagcgcagcatgcagctcaatccccggcagtcagaggtggttctggacgcctgcgaactgctgttgaacgagaacaccgccttcaacacggagcgcgccaagtactggctggatctggccactgacctggatttggtcgacaatcaacacgtcttcgccgtgcggatgcggctgaatcttcaggaaagcaacggcggaggagatggcagcgttgatggagacaacgccatggaactgctgatgcacaaggagctgcaggcgcggccccaggatgttaatcttcgcgtgcgtctgctgcgaagctatgtggagaagaagaagctggatcaggccttcagctacgctttaaaaaccgagctggagtcaaagggcatcacgagtcagtcgagcgattggtatgacatgatctgggtgctcctcgggaagatggagtcggccaatgacgtgaagaagaactggcgcttctggcagttggcgctccacgccctcgatcgcctcatgcaactgagcctggagacgggaagcggactggcggacagcagcagtcagctatttcgcctcgatcaatacctgcacaagtttagcaacgcgatagagcgtgcgggcgatgccccgcagagggaactccaccaatcctgtgccgatcactataccgggcagctgctactccacgcggtggcgctgatcttcaaacgtgagctgctgggtaacaagaataagtggatgaacgcgctgaaatccgtactgccggttttgctccttggctaccaggtgcgaccgctcgaagagtcccatgtccaccactggatgaaacactgcgatgcagagcagaagcagctgatgcaactgtggcgccagcagggcgccttccgctgcgcccagcttggacgcacccttttcggttgtctggatcgatcgcgaacggatgacaaccagaaggagaacagcaacctcaatgagaacaaagttcccgcccaaactttgcccggattatttgccgactccg

SEQ ID NO: 460 - DNA, 414 bp, Drosophila suzukii
cccacgccgaacacaagctgaaagatcagtcctcgcatctggtgcgtaacccgcgtctgcagcagcctcttttcgagtggcccagtctggcggagatcgagacctgtgagctgctagcgttatcgttaccgccgcactccttggcccaacacgtctacttggcgctgggcaccgagcccgaccgtcttggaactgcgccacgcgtggctttctatgaaggttttcggcgggatgtgaagcagaaccttaactactgcggccacgattccatcagccaggtcgatgtcgacctctacctctacgcaacagttattcagacccagcggcgatttcagctccagagggaagcgtacaacacctccaacttgggtaaccgcaatgccgctaaccggccgcatatgatgccatttgcca

SEQ ID NO: 461 - DNA, 786 bp, Drosophila suzukii
tgatgccatttgccaatcttctgagccaactagcatcttcggagcaaacgaactggtgggatttggtgctgcggctgcactcaaaccagctggccactgaaggtaatcgcaccgagcaaagagctcaactgcaggtcggattggaggcggtgcggggggtgaatggacccaaagcagatgcaatcatcattttccagctgggaaaaatcctgcaggagcgctcagaacttgctttggaggcacgcatcgatactctctacaggcaaggatttacaatgctgcgtcgccagcacacgcagcagtcggacgcctttgtccggatttttaagtacggatctgccacctcaacggccgcctggaaggatcttcaagcactggctgagcacgccgtctcctatttcagctcgaagatgttcaaggcgtatcagtatgagcagtttgtggaagaggtcagaggacttgatctgcccatggcatacttcatgcaatcggaggcgtaccgtcaacttgaggagtccgcaaagacaccccgagtttcccgcgctcgtttctcggagcggaggaaggagtgcctgcagcagacgcagcagctgctccaaactgatgtcaagcacccactacacaaccatattcaacgcgagcttcgacgttaccaacaaaatcgcagtagccacggtctcgaagatagcttcggtagcccggatgcgcacaacaattcatccacttatgaggatgctgaagacgacttctatttgggtgcagccttgtctgccaatcgatcacgtc

SEQ ID NO: 462 - DNA, 231 bp, Drosophila suzukii
ctcaggcccaagctcaagcgcaatcccagttcttacggactctaccagctccaggggcgattgcgccccccaatatatttggtaagcgtccaagtgttcaattccttttagatataactgacgatttatttaacgtaggtcctaggaatcaaaactttggactgcccggtatgtttccaccgccgaccggggcatcggtagcaccttacatcgacgccatgggcaacttta

SEQ ID NO: 463 - DNA, 741 bp, Drosophila suzukii
gcaactttacccagcctcctcccagtctgataccgccacccgcccagccagctccagctacggctcctcttaatctgcttgagtcgaagccaccggctgcactgcccactccgggtttcttcaacacgccaacgccgggctttggcgcttcgcctattcaggttccgccaattcctggggctgcccctgccccaggaccgcttcctccatctgtgaatcctgtaccagtaccagctgctgttcccgctcctattcacgtaccccaagtggctccttctgtgcccgctcccgctcctgctagtgttccagcattgtttaaccgggcgttgaacaaccaacccgtggaaaaggaaccgccggccaatgttgtcattaccagctcagatccgttgccaaagccaacaagtgccagtgtccagcccactttgagtgtaaccattcctgcacagcatatcaagcccagtttggtgcaggccccggaaccacaggcacagccaccggttccagcaacggcagccttcagctttaacttcggcacaaagacctccgaaagtcctttctccttcaagtcccaggtggctaaagcagcagccgaaaagcagaaggaacaggaggccgagctaaaccaaagtggagctagtgagaccaacaagagtgttccagcagatacctcagcagacgattacgatcctcgtccagacttccagcccatcatcccacttcccgatgaagtggaggttc

SEQ ID NO: 464 - DNA, 576 bp, Drosophila suzukii
aggacaaggataagaaatcgttcttatggggagcaaatgactttgcggatgagcaggttacgctggagaaattcttggtacgctttaaaacagcggaaacggctgagcagttcagggtcgcctttacaaacgcgagccagccggccaagccagagaagccagcgaaaccggcggagaaaacagcagatcttcccaagaccaacaaggaagcagctgcaactgcttctgctgcgttcactgctcccaaaacctttttgaccagtacgccagctcccaattctcttttcggtaagccacaggagcagacgaaagctactcaatctgatccagctccagcggctcaagcaacagtggccaagtctctgtttggaactatctcagcggtcagtgctgcacctgtaacatctgcgtcctcggcttccgcggcatttgccaactttagcttcacggggaatggaaccgcatcaggattcggcactgcaggcactggctctcccttcaaaaacctctcctttggcagcacatctgcagtgggtggtagcaacaccacgctctttaccacggctttgatcaagg

SEQ ID NO: 465 - DNA, 237 bp, Drosophila suzukii
cggctttgatcaaggacaacacagtgcagagtcagaccccacaacaacagcaactaaacaagtcaactgcctcagacgccgaagaagagtacgtgcccacggcccagtttacgccggttatcgcccttcccgaccttgtggaagtggtcaccggggaagagaacgaggatgtgcttttcgagcaccgggccaagcttctgcggtgggatagggaggctaatgagtggaaggagcgcg

SEQ ID NO: 466 - DNA, 204 bp, Drosophila suzukii
atgagtggaaggagcgcgggcttggaaatatgaagctcctgcgtgatcgttccaatcccaacctggtgcgcctgctgatgcgtcgcgagcaggtccataaactatgctgcaatcagcgtgtgttgcccgagatcaagttctcaccctcaacgaacattaaggcggcggtcacctgggcgggtcacgattattccgatgaggagt

SEQ ID NO: 467 - DNA, 283 bp, Drosophila suzukii
attattccgatgaggagttgaccaccgcattgctagctgtgcgatttaagtcgctcgatgtctgccaggacttccttgatgctgtgcagaaggctcaagagagcattggaaaggaactaaaagaggccgattctgttagcgctacggaaaagaaggaagaagagaagccagtaaagggctttggggatgcctttaagcccaaggcaggcagctggaattgccaggcatgttacacaagcaatggccaggaccagctttactgcctggcctgccaggagcccaa

SEQ ID NO: 468 - DNA, 285 bp, Drosophila suzukii
agcccaaagatgccactgtgccgcccaagcaatcggggctggaccaaggcaatgctttaaaccttactactagcggctcctctagcaagttctcattcggctttgcaccagctgctctttcctccactggtgggtttagcttcggagctgcacagcccaaggagaaaccagtggtggcagctgtgaccagcacggcttcggctcctgcttcagttccgtcgactcaggctacagctcttgaatttggaaagacgtccaccacttccggattcggggacgccttca

SEQ ID NO: 469 - DNA, 1233 bp, Drosophila suzukii
tcggggacgccttcaaacccaaagtcggcagttggtcgtgctccgcttgctatgtcaacaatccgggagagtccctttactgctcagcctgtgaaacacccaaggatgatactgtgccaaagaaggagaatacactaggatcgggacttactctccccgtcaccacccagtttagctttggttttggagctgctgcaactagtagcaaggatcaggctgccgaggtgaccagcaagagcagcaatgtgtttggatccgccaccttcaactttgcggctccagcaatgccgacacctgtggcaccgactacctcaatcggatccagcagcttcagcttctccatgcccaagccagcccaactgcagccgaaaagtccagccgctaacgacggagatgaaaacgactctcacgaggaggaggaggagaacaatgcatattttgcgccagtgattccattgcctgataagatcgatgtgaaaacaggggaggaagacgaggagctgctgtacgtgcacaaggccaaactgtaccgactcaccgaaggcgagtggaaggagcgcggcttgggcgatgtgaagatactgcgccacaaacagaccaagaagttgcgcgtggtaatgcgacgggaacaggtgtacaagatttgcctcaaccacgtgctgaactcgaatgtggtgtacagagaaaagaccgagacatcgtggatgtttgctgtgcacgatttcagcgagggagagagtgttctggagcgcttcactctgcgctttaagaacaaggaggtggcccaaggcttttacgatgcagttaaaaatgcgctagatggcaccgctaaggcaatagaagataataccgattcaaaggccacccccgccctatcttctccttctacgggagcaagtgagtcgaagagttcgtcagataatttgctccacgaccatgtaggtcagggcagctgcataggctgcgatggagacaagttcgcattccgtaaaacgtcgtctgtaagctccaccacctacgaagtaaaccctcccctacccatgaccctgcctatcctgactctcccgcagcctattaccaaatcaaatgcttcctcatcctccgccacctcaatattcaaagccagttcgctgggtacaaccaactctacgttttccggcttcggtaatttatccgtatctgaggaaagcaaagcgcccagttcaacattcgtcttcggtagcacggataaat

SEQ ID NO: 470 - DNA, 602 bp, Drosophila suzukii
tcggtagcacggataaatcagagtctgctaaaccggccgatcccttagccatactacaaaaatctatttcgggcggaggtcaaggcaacgttctgggttctattttcggaagtggcttgtcaaaccaaaattcctctgaggattccgccaagaccatttttggaggtggggccaaaacggctgagcaacagaagaatggctcgccaaagtcccaagaggaacctaaatccatcttcggaggcaccaaagtggagtcccaagatgcacccaagtccatctttggtggcagtggcatagctgcccccactttcggaggctttaatcctttcgggggcgcttcagatggtaaagacgcaccgaagtctatctttggcggcaccccatctatttttggcggccctaaggtcgagacccagtcacccgccagccaagaagcacccaagccccagttcggtaactccaacatgtttggaggctcatcatctggcggctttttgtttggcagtggtagcggtagtgcgaacatcttcggacaaaaggagcccgccgtctctttcacagatattggcaaacaggcagccccggaaaaggagaaggaaaag

SEQ ID NO: 471 - DNA, 293 bp, Drosophila suzukii
ggagaaggaaaaggataaaaccgcgggagaagacaccatggacaagaaggaaactacaccagcagcacagcaggcggccagcacgtttgccgatttggcgaataagactggcaacacattcgccgatttggcaagcaaaccgggcggcacattcgcagatttagccaacaaggcgagcggaaatgattttgccaacctttcggccaatagccaaggcaacgccacgggattcaacaaatcggcgggaagcggcggattctacaacttgacgcaccagaacgctttcaagaact

SEQ ID NO: 472 - DNA, 290 bp, Drosophila suzukii
acgcggtggacgcagagggcaaggtggccaccgagggcgcgctggaacgcctggcctgtcgattcggcaagcaggacatcgccgacgagttcctcaagacggtcaactcttgcatagaacgtgccaaggccctgcagggcgaccaggaggacgacgagagcgacgcggcggaggagcaggacagctcttaaggaaaccggaactaaatatatgtagcatgcttacaactgagtttataagatagtctttcgaaaaagtatcggaaattgttgaaaaagcacacttttcct

SEQ ID NO: 473 - DNA, 264 bp, Drosophila suzukii
acctgcagacgtgggtgggccgcctgtggcaggacctgtgtcatccgcacgacctctccacgctcaagtcgcacctgcgcgacatccaggattcggtcagcgccaactcgccgggtgccggaccgggcaccagtgtggtgtcgcgcccgtttcgtttgcgattgggcgcgccggatatctatgtccatgtaaaggccaactcgagactgttcctgaaccagacgctcggcgagggcgacttcatcatgtccgtgcagacgctgc

SEQ ID NO: 474 - DNA, 207 bp, Drosophila suzukii
gcaaaagcacgaggacctccacgtccaatggctttgctctaccttctaattttttacacattttcaagcatcttcgaacattacttctctttgaactagcaatttaccaatcgtatcccaaatatttctcttcgtctacgattagtaaaactgtccctgtaactgtacatattttcacttaacaattcttctaagttgagccgcctt

SEQ ID NO: 475 - DNA, 228 bp, Drosophila suzukii
cccacgccaagtaaacggatggaatctaattcggaatcggaaaaagcatttggaacgccgtgttgtgttttccatttttttccggtgtgaacatatacccaaaaatatatgtcgacgttacttgagagcgagtctaagcatcccagaattaaacaacaaaaaaccctttaaaaatcacaacttttatgtgtttatttttttcgagtgcagaggaagctaacctcaaac

SEQ ID NO: 476 - DNA, 207 bp, Drosophila suzukii
ccaatatcgatgtgctgctctgcgaacaggaagtggtggccaccgacaaaacggccatcgatactatcctcgaagctgatgtgcgacgcacggagatgctgaagaaggcggatgatctggagaaacagttcgccgctggcgatttgagtgttcaggaggaacttaacgacgcgtttacggagctaaaggccattggagcctactcgg

SEQ ID NO: 477 - DNA, 228 bp, Drosophila suzukii
ccaacagctgattttaacacgcagttgcttgtgtttttccgttctcttcgaatttcacaacaattggtctattcattgatttattttagtgacaaccactagttcagcctaaaatgtctctggttcgaaattcctcccggctgctgcaatcgacgttgaagcgtgtgcagagtgtgccggtggcattatatcacgaaaatgtcgttgaacactacgaaaacccgcgca

SEQ ID NO: 478 - DNA, 231 bp, Drosophila suzukii
acagcgacgccaggagcgaatcctcctcgtcggccagcagcgggcgcgaagaagaggaagcagagccggagcaatccgccaaagatgcgaaaaaaactgatgatagggatcgggaggaggatagcgataaggaaggagtagctaaagaggatgaggatccgcgtgaccataaaaaaaatgcagctgaagataccccctcgccggccaagccaatttcccattctgctggcg

SEQ ID NO: 479 - DNA, 232 bp, Drosophila suzukii
cagcaagaagaagcagctgctgcgacggcggaaagtgagaaattaaatgaagcggaaaatgtagaaacacctgtccaacgggaagaagaagcagaagccacaggtgtgacgaaaaagctggaaagcccgaagacacaggcggagcacgttgaaaaagaagcagaagagcggggaaagggggaggagcagccggtgaccaccaatggaagcaacggaagtagcaaggaatcgc

SEQ ID NO: 480 - DNA, 412 bp, Drosophila suzukii
agtagcaaggaatcgccggaggaaacagctgccggtgcagtggaacctcctacatcggacaaccacgaggagggcgaaataaccgataaagacgatgatgacgagccgcctgccaaggagagtgagaaacccggcgccgcccagagcagtccatccaaagagtccaaccgccaacgcagccacagccaggacgacaagagacgtcggccacgatcctccagtaggagtccctcgcctcgcagccgtcgtcgtcctcgctcgaggagcgggaacagtaggacccgaagccgcagtatcagtcccattcgccgtaggtcgaattccttggagagacgacgcctggagcgccagaggcgtcatgaggagcgggataaacgggatgaggcaagagctaaggagcgagaaaagcgcc

SEQ ID NO: 481 - DNA, 286 bp, Drosophila suzukii
agcgagaaaagcgccatcagaagcgtgataacaggcgtagagatgattccagggaaaggaagaagtcttcagatcgcaagcgagatcgttccacctccagcccaggatcgaaatcatccaaaactgctcgccatccagaacccactaatgctgataatgaaaccgtaactgaacctgctgccaagataacagagcgtcaacggaaaacggtggatgttttaacctccagaacaggaggagcctatattccaccagctaagctgcgtttgatgcagtcacagatcac

SEQ ID NO: 482 - DNA, 274 bp, Drosophila suzukii
tgcagtcacagatcacggataaagcatctgctgcctatcagagaatcgcttgggaggccctcaagaaatccatccatggttacatcaacaaagtgaacaaatcatccaaaactgctcgccatccagaacccactaatgctgataatgaaaccgtaactgaacctgctgccaagataacagagcgtcaacggaaaacggtggatgttttaacctccagaacaggaggagcctatattccaccagctaagctgcgtttgatgcagtcacagatcac

SEQ ID NO: 483 - DNA, 372 bp, Drosophila suzukii
tccaactgaacgaggatgacaccacgtcatcgagcaggatctttataaaaatcctatttcaggagctagctgagtacatgggcttgggcaaactaaatgcaaagctcaaggacgaagtattggttgaaagcctggctggcttgttccccaaggataatccaagaaacacccgcttctccattaatttcttcacctccattggtttgggtggtctgaccgatgatttgagaagattcttgaaaactgcccccaaggctgttcccgcaataaatgccgaaattctggccagtaccggagggaatcctttcaaagatgggtctgctcccgctggaaattccaagataaccccaccgtcgtcctcctcgtcatcat

SEQ ID NO: 484 - DNA, 617 bp, Drosophila suzukii
agatcaagcgccaggagcaaatccaaaaaaacaacaaatttcgggggcaaccgcaagacagtgatgaattcaacctagaaggtcctgaatctagagaacgcaatcgcaaccagtcgaatggcaacggccagagacgcagggacaactctttcaacagacaaagaaaccgggattctacttcctatggcagggatcgaaaccgagagaattcttcacacgacagagaaagaaaccgggaaaattcatatgacaaagaaaggaaggttcaaaagtctatctctcacgataagcaaagaaaacgagatcgatccctttcttatgagaaacctcgcagaagagaggattcttcccctcgcgaaagacgtgttgagaagaacagtcgtggtgaaaaagacagccgacgtggtgatcgtttgtccagagatgagaggtcagatcgaggtgaaaggtctgatcgtggtgaaagatcagatcgtggtcgtgaaaaggaacgtgatcgcgatctgaagagacaacggggacgcgaaagagagcgtgaccaggaacgcgtcgaatctcgtgaccgtgaccgctcgcgaggagagcgcagttcacaccgttccaaggggcgtggctga

SEQ ID NO: 485 - DNA, 372 bp, Drosophila suzukii
cgggcctcacccagggtcgacgctatttcctgagagcctcctgcggaaatgtcaagggatggggagcctatcgaacatcggtgccagctagtgtggtgccctcaacttggagggatttggacaatcgggaggatcgatttgtgggtcgccaccgtatcctggacaatctgtttaccgccgtgcggttggctagaccatccgacgtctccgaactgaccttggatcccgcgagcgcccaacggcgcaatcctaaaaagaagactaccatcaagcaattgttctcggtcacctccaagtttcaaaagacactaagacgcggtatatacttctcttgtataatccactgcgatgacaaagtgctggtcaccagcg

SEQ ID NO: 486 - DNA, 315 bp, Drosophila suzukii
cctgcacctgggaggatgtgaagtccctacgttcggatatggaacgcaatctcacctctgccgttcacttccgcaccaaactcctttcggccgtctgccagatgcaatcggcgttggggatcacggacttgggtcagctctactataagccacttcgggatgcccagggcaccgtggtgctgacctgtgtgcaatcggttaagagccagaaggccgtctccatcctaaactcccgatggctgccagtcagcaagctgcagaagaagctaggtgctctgcacgaggattataccatcaacgagctgctcatctcct

SEQ ID NO: 487 - DNA, 201 bp, Drosophila suzukii
atgcaatgcacaaactgttcgccagtatgaacatcaagggcgtcgaggcaaccactcaccgcctgtacgatgtggaggtgattgagcacagtccggacataagtttcctagtggtctgtccatccgccgaatcctcgtgtgccgtgcccggccagtcggagttactgctccagagagatgatttggccagcttgagtatcc

SEQ ID NO: 488 - DNA, 279 bp, Drosophila suzukii
cttcgcggctgctggacaggctcagcattgacgaacgccaggaggaggaggcggaatacaagactgacagggggcaggttgaggatcctcttgctctgcagcagaagaaaccttccaccaagctgcttagtaagcctccactgaagcaagagaaggcccaacccaagctggagaaaccccaagagaaaccccaacccaggcaacagaagaaatccaccaccaaagaagaaacccatcaggataacctgccctcgccttcccgcaacaaataccaaaacg

SEQ ID NO: 489 - DNA, 660 bp, Drosophila suzukii
tgttaaaatgaattagcactattagtaaatgtttttgtgtgcgtgttcttccaaaaacaagcgctgtcattgaaagaaaagctttggaaatttcagtactgatataattataacagtcttgttgtgttggttactcttgcagcacagaggaaatataaaacaaaaaaggcatgtacatatgctaaggactatttgtgaccaaaaccaaacttgcagacataacctaaatatgcataacctatgtatatggtggtaacaatacaagcgaattgtctcgcgtatgtatgttatacgagagtgtacgtatgtgtgtatcagtgcagaaataattctgttcgtttgtgtatcatgcattggaaagtgtttgttgtacatgtgtacatacatatgttccatgtaaagagttgccacgctttaaaaattttatataatgacgtagaagcatctgtcagttacttgagttgtggcacaaatttaagcgttttcctggccagctgtaagaaaattgactaaggctacatgcttccacattattgtacatatatgtacgtttttacgattgccaccttacacccctagttactatccaatgtttgcttttcaactaggtggcaatattgacatcagccataggtgtatgcgtttatttaatacactagt

SEQ ID NO: 490 - DNA, 224 bp, Drosophila suzukii
atttaatacactagtaactagtaccgtccccgttgttgaacgtgcaccgaaattaaaattcaattacatcgaaatataattattctttgttcaaaattgttgtccactctcgagataattttaaatatctgcaaataagtttaaagctactttgtgaaatgtgaaaaacagtaattgagtgtcgaatgtgtgtgtatgttttactacacatacacactttgtga

SEQ ID NO: 491 - DNA, 325 bp, Drosophila suzukii
gaaaatcaacttctcgttcggtataagcaaaaattcttgcgaatattctgcgctattagcgtaaatgcgagtgtttaaacttaatataaacgcgggcagtgctaaataattttcctcttctattgaactcggaaggcgcaaggaaaaatatttcttatttttttgtaggaaattaaaaagttaataaaaattgcgataaatgcttacgataatgacgttgaaaaccaagttgatgctggaatagttgggaatgccacttttgaagctgacgatcagttagaacatttgagcactatgcgcgaggcgcttttttcccaagatggct

SEQ ID NO: 492 - DNA, 218 bp, Drosophila suzukii
gagatccccgtggaatatccggtcgtcttaatggaacatcggaaatgtgggggcatcatccgcaaatgtcgcacaaccaaatacaaaatatgaataaaatggttggccaaagtgtggcaactgctagtacgaatgttggagggacatcaggcccgggtatcggaccgggcggtcctggtcctggtcctgtatcaagcagtatcccaacacagtggggg

SEQ ID NO: 493 - DNA, 276 bp, Drosophila suzukii
ggaaagacatgactgattcaattggccgtggtggtcatctgatgcgtggtcaaaaccagtcgggtggcatcggtatcgcaggagttggcaatagcaatgttccagttggagccaatcccaacaatcctatgaatagtgtagttggaccccaggctcgcctaccatctgtgggaggcgtgcaacacaagccagacggaggagccatgtgggtgcactcgaacaatgttagtggcaggaacaacgtagctgctgtcaacacttggggagatgacactc

SEQ ID NO: 494 - DNA, 282 bp, Drosophila suzukii
cttggggagatgacactcacaacgtcagtgtgggtgcccccagtggtggaggtgtatccagcaataattgggtggatgataaatcgaacgcaacactggctcaaaactcttggagcgacgcagcaccagttggagttggatggggcaacaagcaaagcaaactgccggccactagcacatcgtctggttggagcactggggcaggtgtaggcgtggtggatggcgttgacctaggatctgaatggaactcacatggagggctaattggaaaatctcagcaac

SEQ ID NO: 495 - DNA, 268 bp, Drosophila suzukii
gccaattcaaataaatctggtaacggtggaaatagtagtacgtcaacaccatctaatattaccggcggtgctaatggttggctacaggctagaagtggtggtgttcaaacgacaaattcaacttggactggtggtaatacttcttggggctctagttggttgcttcttaaaaatctaacagctcagattgatggttctaccttacgcacattatgtatgcagcatggccctcttgttagctttcacctatatttgaaccaaggaattg

SEQ ID NO: 496 - DNA, 361 bp, Drosophila suzukii
agcaacggcaacggtaacggaagcagcagcggcagtggtggcggcaccggtaataatggcaacaacagtggaaacagcagttgcaccggcggcagcaacccaaacaccagtgtggcaaattcgaatctacttaattctagtggagggtccgtttcaaattcatccggtggtgctgctagctctggtacgggttctgcagtaagtggaacagcgagtggtaataccattaatggtggaccggcaaacaatgctggctcaaagactaatgcaagcaatgtaactataactggtggtcagtctagcgcttcaagcctaactaatagcaccaactcaacatggcgtcaaactagccaaaaccaag

SEQ ID NO: 497 - DNA, 243 bp, Drosophila suzukii
tatagatatacatatatatgatgtcaaaaaatgctatacttgatggtttgctacaacaaaaaaagcataccttcctatttaagtaaaagtgttttgactctggcgcccatagcttatcttgggaaacggggaaaaatttcaacggtgtatatgtgtgcatggtaaaatatactgtaataaatattatgtattgcaacatctatgcatatatttatggaaaatttaaattttcagtaacgactg

SEQ ID NO: 498 - DNA, 203 bp, Drosophila suzukii
aaatcacaataaaaatatcaatgaagttatttattgcctttgagtattgagacatttttgttaagcgtgggaactaattctattaatatatgtctgtttagtataagtcatttaattttatgaaaacttaaatatgtttaagaagtattgtctcgtttactgtattgcatgcggacccatgctctaaattgattggataagtg

SEQ ID NO: 499 - DNA, 289 bp, Drosophila suzukii
tctatgcgagcaatccctatgccattcaggtgaagcaggagtttcccacgcacacggctggcggcgggggaaccgagctgaagcatgcaaccaacatcctggatgttcagcaacagatgcaactccagcagcagctctcggatgccagtggagggggaggagcaggcggaggatcatctggaaatgcaggagcagcaggaggagcacctagtccagccaattcccagcagtccactgccatcagcaccatgtcaccgatgcagttggcggcggccaccggcggagtggg

SEQ ID NO: 500 - DNA, 272 bp, Drosophila suzukii
tgatcaccgccggcaagcccttccagggcaacggcccgcagatgctcaccaccacgccgcagaacgccaagcaaatgatcgcgggccaggcgggattcgccggcggcaactatgccacctgcattcccacgaaccacaaccagtcgccccagacgctgctaatctcgccgatgaatgtcatctcccactctccgcagcagcagcagaacctgctgcagtcgatggccgccgcagcgcagcagcagcaactcactcagcagcagcagcaacag

SEQ ID NO: 501 - DNA, 278 bp, Drosophila suzukii
agtctgttcagactgcccagctcttgaacgcgggccaggcgcaaatgcagatcccctggggattctggccgaatgcggcaggtctgcagcctttcggctccaaccagatcatcctccggaaccagccagacgggacgcaaggcatgttcatccagcagcagcccgcgacccagaccctgcagacacagcagaaccaaatcatccagtgcaatgtgacccagactcccaccaaggcacgaacccagctcgatgcactcgctcccaagcagcagcagcag

SEQ ID NO: 502 - DNA, 234 bp, Drosophila suzukii
gtgcccattgattcgcccatgacgccggtatcgggacatgacacctgcaccacacccaaatcctccactcccgccaatgtcagtgcacccgtggaggccagtagttccacgagcgaggctctgcccaacggagaagcttcagatcgagcttcgacgccctcgaaagtcgccaccactcccactagtaaacaaagcaatgcagtacagccaacgagcagcagctccacccccacc

SEQ ID NO: 503 - DNA, 801 bp, Drosophila suzukii
ccacaaccaccacgtcgagcaacagcaatgggtccaaggatctgcccaaggcgatgataaagccgaatgtcctaacccacgtcatcgacggtttcattatacaggaggccaacgagcccttccccgtcaccaggcagcgctatgctgataaggacgtcagcgaagagcctccaaagaaaaaggcagccatgcaggaggacatgaagccaagtggaatagcgtcagctccagcctcggacatggtggcttgcgagcagtgcggcaagctggaacacaaagcaaagcttaagcgaaagcgctactgctcgccaggatgcgctagacaggcgaagaacggcatcggaggagttggaggaaccggagagaccaacggcctgggaatgggcggaattgttggagtggacgccatggctttggtggacaaactggatgaagctatggccgaggaaaaaatgcagacggaagccctgcaggcaatgtccgaatctctgcccatgcaggcggctccaacggaagttccatcgatcacaatgccagtactatctgctattccggcatcttccccactttcgctgccccttgcactgccgttgccagttgcaatacttccagccatgccactgccagtggccccagctggagtagtcactcctgcggcagctctaccatcttccaacgtaaatggatcggatcgcccgcccataagcagctggagtgtggaggaggtgagcaacttcatcagggaactgcctgggtgtcaggattacgtggacgacttcatccagcaggagatcgacggcc

SEQ ID NO: 504 - DNA, 413 bp, Drosophila suzukii
tggccaaggtggagtccatgaaggaggtaccgccgccaggcgatataaaggatgcggcggccggaggagcgcaatagtgtcagcgggatgagccaggtgagatgatgccttcgccctcgtattccattaccccgccaccttattcgccggtgggtccggggccggacaggcaaaccgctccgtctccgactccaactccgactcccactcccgctcctgccagcactccgccagagtctgaggatagcagcgggggcagtcacctgtgcttcgatctgaccacgcgcctctgccacgaccttcggctggaggaggagccatagctctggaccgggtccaaccaggtccggcgtcgcccatgctgaatgtgattcacttggagcacgctgtagaaccttttgtacgtaatctaa

SEQ ID NO: 505 - DNA, 417 bp, Drosophila suzukii
ttgaacgaatgaagcgcaagggcgagagtatcaaaaaaccatccaagaaaaaatcgaaaaggcaaaaagaggataaggacaacaagaaaaagaaatctaagaaagaaaaatcaggcagaaaagaaaggaaatcttcagttagcgacagttcagactcctcttcttcctcgagtagcagcgattccgaggacaaccacaaaagtaatcataaggaagacaaaagaagtggtcatcaaaggtctagggactcggagcacacccaccaacgacgaagagatgaaagtagacatcgcagagttaaatcccgctctagaaatcggtcccggtccgccagtaaagacagaaggcgggaaagcgagcgcaaggagtactccagacgatagtattatctttgtaataacacaccaataaattcta

SEQ ID NO: 506 - DNA, 202 bp, Drosophila suzukii
gcgttttcaagacggccctgaccttcgtggactcgatcgccgagctgtggggtccgctgatgtgtggcctggccatcctggtggtgcccaaggcggtgaccaaggacccccagcgactggtggccctgctggagcgctacaagatcagacgtctggtgctggtgcccacgctcctgcgatcgctgctcatgtatctgaagat

SEQ ID NO: 507 - DNA, 213 bp, Drosophila suzukii
actatggatccctgaagaatggtagcatcatgtacgagggtcgaaccgactcccaagtgaagatccgcggacatcgcgtggacctttctgaggtggagaaaaatgtggcagagctgccgctggtggagaaggccattgtgctgtgctaccacgccgggcatgtggatcaggccatcctggcctttgtcaagctccgcgatgatgcccccatgg

SEQ ID NO: 508 - DNA, 558 bp, Drosophila suzukii
ccaaattgggtctggattcaatgctgctcgaagtaatagaccgcaaggaggccgagcccttgtccgaggacgacgacgaggaaaagtctgaggccagtgccagtggaggactgagtgtgttcgatgctctaaaggctggcgtaaagagtgacgaaaaggaggatggtgccgtaagagctcaggacgatgccatagattattcggatattactgagttatccgaggattgtcctcgcactccgccggaagaatcaacgtcctacgatgacttagaggacgccattcccgcttccaaggtggaggccaagctgaccaaggacgacaaggaactgatgcctccacccagtgctcccatgcgatcgggctctggcagcggaactgatgaaccggccaaaccaaacgagggctccagtcccggcggcgactccaagtccaccgatcccaaagatgcggatcgcaaactggacacaccgctggccgacattctgccctccaagtaccagaacgtggatgtgcgcgagctctttcccgactttcgcccccaaaaggtgctacgct

SEQ ID NO: 509 - DNA, 321 bp, Drosophila suzukii
acgtgcgcaaacgccgccggaagcgcaatcagtccagggatcagaagatgttccgctttgcggacgacgcctttctaatggtctcacagctgcactgggaggacgacgtggtctgggatgggaacgacatcaaggccaaggtgctacaaaagctcaattcaaagacaaatgcagctggatggctgccctccagcggatcgagaactgctggcgccttcagtcagccgggaaagacgtccctgccagtaggaaacagcagtggtagctccaagcagggctcagcggcatccagcaaaaaggcacagcaaaatgctcaagcaa

SEQ ID NO: 510 - DNA, 272 bp, Drosophila suzukii
gggcccgatgaagctccgctctttccatcgccccccactcaagaagtactcgcacggaccgatggcccaggtttcgccgcatcccgtcttcccactgctaaagaccatcgctaaaaaggccaagcagcgagaggtggagcgcatcgcctctggtggcggagacgtcttttttatgcgcaacccggaggatctgagcggcagggacggagacatcgtgttggccgaattctgtgaggagcacccgccgctgatgaaccaggtgggcatgtgct

SEQ ID NO: 511 - DNA, 300 bp, Drosophila suzukii
ttgagaacaacatgtaccgtgcgcccatttatccgcacaagatggcacataacgatttcctcgttattcgcacccgaaacagctactggatccgatcggtgaactccatcttcacagtcggccaagagtgtccgctgtacgaagttccgggtccgaactccaagcgcgctaacaactttacacgagactttctgcaggtctttatttaccgcttgttctggaagagtcgcgacaatcctcgccgcattcggatggacgacataaaacaagcgtttcccgcccattccgagagcagcatcc

SEQ ID NO: 512 - DNA, 255 bp, Drosophila suzukii
cgactcgcgcatatatccaggccatgcgtggaaagtgtttgctccagctgagtggtcccgctgatcccacgggttgtggtgaaggattctcttacgttcgagtgccaaataagccaacgcaaaccaaggaagaacaggagtcgcagccaaagcggtcagttaccggaacggatgcagatctgcgtcgattgccactccagcgtgcaaaggagcttctacgacagttcaaagtgcctgaggaggagatcaaaaagc

SEQ ID NO: 513 - DNA, 393 bp, Drosophila suzukii
gttataaggaagagtgccaacgcattttcgatctgcagaaccgagttctcgccagctcggaggtgttatccaccgacgaggcagagtcgtcggcctccgaggaatctgacctcgaagaactgggcaagaacttggagaacatgttgtccaacaagaagacctccacgcagctgtcaagagaacgcgaagagctagagcgccaggagttgctccgccagctggacgaagagcacggcgggccaagtggaagtgggggcgccaagggagctaagggcaaggaagaggccggccagcagttgctggccaccagcaatcaaggtcgcattcttcgcatcacgcgtaccttcagaggaaacgatggcaaggagtatacccgcgtggagactgtgcggc

SEQ ID NO: 514 - DNA, 216 bp, Drosophila suzukii
gcagagtgggtggcgatctccactgcgactacctacagcggcacaacaagacggccaacagaaggcgcacagatcctgtggtggtgctgtcctccatcctggagatcatccacaatgaattgcgttccatgccggatgtcacaccgttcctacagccggtgaatgctaaaaaagtgccggactactaccgcgtggttaccaagcccatggatctgc

SEQ ID NO: 515 - DNA, 468 bp, Drosophila suzukii
ccatggacctcgaaactattggcaagaacattgaaagtcatcgctatcacagtcgagccgagtatctggctgacatcgagctgattgccaccaattgtgaacaatacaatggcagcgatacccgctataccaggtttgccaagaagatactgcattacgcgcaaacccagttagaggtgttcgcggagcactgtgctcagttagagaataacatatccaagacccaggagcgtgctagagagaatgcgcctgagttcgaagaagcctggggcaacgatgactacaactttgaccgcggcagccgtgctagctctccaggggacgactacatcgatgtggagggccatggggtgcacgcgtcctcatcgaattccatccatcgcagcatgggagctgagttgggttcgactcatgccgcgccgtcattgcggaaatccgcaccccctggacctggtgaggtgaagcgcg

SEQ ID NO: 516 - DNA, 363 bp, Drosophila suzukii
ccagtcaaacggatctgtgcggatcatcgggggacaacctaaatggaggagctcgtttcgcggagatggccaagaccaagttgcagtacgccgagtggcgaaagcacatcaagaagctgcagcaacagttggccgatcatgtccttacatgcatgtgctcttcctccagctcgatgagccggcacgatccggaactgctgagggccgacctgatgttggccagggaacgagtccatcagctaaagcaggagctgacccacattaccaatgatatatcctacacggagcgcggcatgaacacgctgtattcggtgggcgagaagatcaatgcccgggagaacggatgctacgacatcgccgagg

SEQ ID NO: 517 - DNA, 202 bp, Drosophila suzukii
agatcagcgaggagaactccgacctggcctcgcctttcgaccgagtgtgtgtggccagtcagacggatctgtgcggatcatcgggggacaacctgaatggaggagctcgtttcgcggagatggccaagaccaagttgcagtacgccgagtggcgaaagcacatcaagaagctgcagcaacagttggccgatcatgtggagcg

SEQ ID NO: 518 - DNA, 222 bp, Drosophila suzukii
cggcggtcagcaatgaatcagtggccggcgactcgggcgtctttgaggcatcgcgtgctcatctaccgcgtaaagaactggcacaggttcagattggtttgaagtatctgaagcaggaaggagtactcgtcgtgtccctggagcgggccaataatctactggccctttggactgcttcggcagacaactcgcaagtgtatctacgtgctgcgttgctgccga

SEQ ID NO: 519 - DNA, 252 bp, Drosophila suzukii
tgcagtgcttcagcgatctgaaggacaacgccatgctccccagcgcagcctatctgcaggtgctagccaatcggttgactctggactcccagggacgtctgatcctgcgggacaatggaaagattgtgctgcccttcgagcactttgccaatgcagtgatgctgaagcacatgtccggaccacatggcctgcaccttagtgtggatgccactgtgcgggcggtcatcgagtcctacaccatcggtcgggatc

SEQ ID NO: 520 - DNA, 226 bp, Drosophila suzukii
ctgcagccgccaatcttcagatccagggactgatgcaatcgcaggcggtggctgccgccgtggccgccaaccagccaccgacggccacagccacatccgcggcaggaggatctgcagcaggccctcaggcccatcacggccatcatcctttgccgccgccatcgcagtcgccgcactcgtcctcttcgtcttcctcacactcctcgctggaccagattacccacaa

SEQ ID NO: 521 - DNA, 228 bp, Drosophila suzukii
aaacaacaacacccacacaggcagatgcactggcccaggcgaaaaaaaaacgattgcgcaagccacgctacgccaaatatgtggaactcctggaggtcaccgaacaggccatcagcgagcgaagatcaagggtcaagcgtctcaagtccaaaaagctggctgactttatacagaaagcccagcagcaaatcctggagcgacgagcccgggaagatcgcaaggataaga

SEQ ID NO: 522 - DNA, 224 bp, Drosophila suzukii
ttggcaaggatgagtacaccaaacaggtgattgcgaatcccgaggaaatgcagaatatcctcaagagcttccacaactttcgggatatcattgagagcatgggcaatgatcagcacgaagcggactttgggctaaataccgccaaggtgcttcctgaagaagccgacgtcctggatcctttcgaagccattgagccgtacataaatcccctggacaagagcaaa

SEQ ID NO: 523 - DNA, 333 bp, Drosophila suzukii
tcaccatcgacctgtacaatatacttctacacggctacgcggccaagggatcctttgatcgctcgcaggagctctttaaactcatcgaggaggatggtctgtcgttcaatgagcaaagctatgccgccatctttgaatgcttgggacgccaggaaccggatgaacagaatcaacagttcatagccaagtacattgaacaagctgaaaaggaagggtttagtttaaatcaaatcatggataaatctaagtttgtggccgatcagcgggacattgccctggatgcccttcgaagacttcgcccggatttcaagcctgtctatgtgccaccgcaac

SEQ ID NO: 524 - DNA, 258 bp, Drosophila suzukii
tgaactccaagcgaggctacgccacagctcaattggagcagcttgctagggagcaactcaaaatagagctggatggtagcattaccatcaaatccattgagaaatctaaggagtttgccaattccgaaaaatgccgcgaacgcctaaaggaattggaggaaacatggcgcaaacaaatttcgtcggccattgtgcgggatcttaacactctgcgagcccaagttcgcttcaaaccacatggcttcatgaactactaca

SEQ ID NO: 525 - DNA, 378 bp, Drosophila suzukii
agcagaagaaacacaacggaacgctggagaagattggagagatttacagctcgtactgtgaactgtgggacagcgggaagtcacaggataacacgcggcaggcttggcagcgtcttgtgcacgaacagcgagagagtggacccagcatggatctaccagaggttccgtggccttccaatgtcctgaccggcgtgggtcggtttctgtacaacattttgatgcgagacatcaagatcgatgctcatataatgaggcaaaagagcaaaaccaaagcggtttctcaaccacagaacatgttgcccgccttctacactctcttccgcaatcaagggcgttttgtcaaagaggaagttaagccacatccggtgctctcgagat

SEQ ID NO: 526 - DNA, 243 bp, Drosophila suzukii
tggactctgcggacaatccgcttacaggtcgtatgtggtgggccaaatcagatgagccctggcaaacgctggcctgctgcatggaaatcgccaatgtgcaccgctgtcccgatcccgccgcctatcttagtcgctttcccattcaccaggatggttcctgcaatgggttgcagcattatgcagccttgggaagggatgaagcgggagcctgcagtgttaacctagcaccatcggccattccgc

SEQ ID NO: 527 - DNA, 204 bp, Drosophila suzukii
gcggcatgggcggcatggtcaatcatctgaagcagcagccaggcggcggtggcggcggtatgatcaatgccgtctccgtaccaggtggacccggagcgggacctggtggcgttggcgctggcggcggcggagcagttacccccaaccagggcatgcacatgcagaatggccccatgatgggccggatggtggggcaacagcata

SEQ ID NO: 528 - DNA, 422 bp, Drosophila suzukii
cgctcgcgaggatcgctgaacctgagcagcaatggactaaatgctttgggcctgggacccgtaaccctggccccaaatgtcagttcgagcagcagtggcagtgtcgtggacttgaccctgccacccggcatgactgttggtgatgttggaggaaggggatcaggaggtagcagctcaaatatctatgcctcgccctccaaatcgaacctcaagtcctctttgaagtcatccagttcgactgggcagcgcggatgcgccctctttctcggagtcgacggtaaattcctgtgctgtaacatgaagcttggtttcttccatcatgatccttctacagatggcctccagcatcttcagcagcagctcaagggtcagaagttgtcttctggaccgaaacaagtaactgtggcctgttgcgagtgcgt

SEQ ID NO: 529 - DNA, 534 bp, Drosophila suzukii
agcagcagcaacagatggtgatgttgcaacaggtaaatccggtggaatatcaacagatagttcatcagcaacatcaggggattggacaccagcagcatcaaggaggggttattcagctgcagcatcaaggagggttaggggttgctcagctgcagcatcaagtggttacacaccaacaacatccgcagctgaaccaccagcagcaacatccgcatcagcagataatccatcagcaacaacaccagatggttacctatccgcaacacccacaaccacacccacaccaacaggtgggccaccagcaaccaatgatgcagggtcaactagcaccgccaccgccatctggcggccatgttgtgcaccgcctgcttcccacaccgcccacacacagtggcttgggggcgttccacacccgggaggcggccctgcagagggtgcagcagcagagcggctattataatcaaggccccagcacttcggcatcggcctatggctataacctatccatggagcaacagcatccgcatcagcatc

SEQ ID NO: 530 - DNA, 254 bp, Drosophila suzukii
tgccagggatcgcatgtcaatggccggagtcttgaccttccagcaggccatgtccggagcggtgtcaccacaatatggcaccgtgggttctctgaatccgcaaggtaccggtgagaagaaaccgggaatggttggagccgatgccatgggaataggtggtctacctggcggatcggctaacaatatcaatttgaccgtgggcttggggtttctcggtggatcaagcaccaccttagctgctgtcgccgaggtga

SEQ ID NO: 531 - DNA, 252 bp, Drosophila suzukii
atcccagcgtgctcagcatccacgaagagctggccgcccgcgaggccaaggactcgacaagcgggctgaatcaacagcagatcagcgaaaacacaatggagggaatcctggctagcggcatgctcaatggcctcgatcctcaaactatagtcggggtccttgtgtacaatcgatttattcgcgtgcatccggactctcgcctgatggcagctattcgtcagggaaccgagttcctcaacaagtacatcgacg

SEQ ID NO: 532 - DNA, 249 bp, Drosophila suzukii
tcaacaagtacatcgacgccggaaagttggaggagctcaatgatgtggtcccagtaagggatcgctccagatccgtttcgcccacggtggaggtacgaggggaggtggtttctcctcctaccaagaagtcccgctttgaacctcgacagcataacgctcaattggtgtgtgttcgagaactgctgcaactgaagaagcccttcttgcaaaccctggttgcggcgaaagcccagcaacccaacacggagt

SEQ ID NO: 533 - DNA, 612 bp, Drosophila suzukii
atgccaaggactttatcaacggagagcttctagcacatctctatgcgtctggcgatcagtcccagatgatggaagagtcggctgagtccgctacacgacgagaggagatgctgcgaatgtaccgtgcttgcaaagacgctttgcagatcataggtaaatattaacagactgctggaatttttatacccggtaatcgtagagtaaatgggtatattgtattcgttagaaagtatgtaataggtagtagggagtcatttcgaccctataaagtaaatgtgttcttgaccaggatcactatccgagacaaactattgatgtccgtatgaacccggagtttcggattacccttgcagattcaatttgagttagttagctgagtaatgggtatcagaaagtcgagacattcgactatagccttctccctcgttaacgtgtatattaagagctctcccacatttacttgaatttaaggcgacgtatccatggcaactgtgtcctcgcccttgcctcctccagttaaaaatgattggctaccaagtggtttggataacccacgtctttcccctccaagcccgggtggagcccgaggtaaaccaggacctcccgcacaga

SEQ ID NO: 534 - DNA, 201 bp, Drosophila suzukii
ccattgccatccagccagcgaccgctccggcagcactaaccagtttctatccgggatcaccgcctgcctcgccgccgttctcttattcaggatcaccggtgccctcgaccttcttcagcttcgacgagccatcgcagaaccaattccacaaccaatcccagagcctgccgcccacgcccactcgccgcacatcgcgcgcct

SEQ ID NO: 535 - DNA, 206 bp, Drosophila suzukii
tgagctggatcagattatattggctccattgccacgcgatctggactctttggaacatgtgcttgagattcactcggactatgagcgcaggttgaaccttttggagccagagctgaagcatctgcaagagactttccgtacgattgccctaaagacgcccgtgctaaagaagagccttgacaacctgatggagctgtggaaggagc

SEQ ID NO: 536 - DNA, 321 bp, Drosophila suzukii
aaagctctacgaagagcgtttacagcagcgatggcttggatgctgctaatcaggagggtagcaccactaacctgccccagtcccagattcagtttaacgaaatccggacgcttaagcgctcccaacagctgggaagccattccgtgctcgatatagccggaattcgagatccgcgtacaggtcgcgttttaaccatcggcgaagcgattcagctacgcatcctggacgtgcgaaccggcgagatgttggtggctgaccgccgcatcacgctggaacaagcagccgaccaggggctaatcgatgcgcagctggccgggcagt

SEQ ID NO: 537 - DNA, 200 bp, Drosophila suzukii
tgatttggtctatcacaatttgattgacccgaagacgggatatctgttggatcccaagagcggggagacagtgcctctagataccgcgatcgagcggaagtttattactccagagggtgctcttcttttaagcagtttgcttaacatcactttgactacggagacggtgacgcggacgattaatcgttatgtgacaatca

SEQ ID NO: 538 - DNA, 246 bp, Drosophila suzukii
agaagtcggtggagattcccatttcccaggaactagtgaagccacagcgtgtagtgtccgaatttataaatatggaaaagagcagctatatcgaacaaaacgtgacggagcggcagatcatggagctgcctccaggaggttggcggctgaaagacgccatcgagcagcggttgtttaacccagatacaggagtattccatgtgcatggcacggatcgcttagtcaactttgaggagtgcatcaaca

SEQ ID NO: 539 - DNA, 459 bp, Drosophila suzukii
taatcttcacgcaaaccggggagactgaaaacattcttgatgccgcccgccagggactgatagacgatcagctaatcaagattgtagatcctacaaccaagcaagcgatttccataactgaagcgatagcgcgttctatttacgatcccaagaccgccactatacttgattctgaaggacaacctgtggacctgatcacagcaactaaactgggtctattgagtgtcgtgggtgccccattggttgccgccgaaggagcccttagaaccgtacgcttcgtcaccgatccgcgaaccggtcaacaaatacctgtggaggtggcttacgagagaggcattgtctcacgtgatcagctgcatcgcgggcgatcctttgatagtgaaccggcgaaagttgaggagaaggtggtagtgttgcaaagaatgcgaaaggtcattctgaagccaaaggatgctttac

SEQ ID NO: 540 - DNA, 249 bp, Drosophila suzukii
atgctttacgaaagggaattatcgacgaggagacatgtgagatactcgagaatacaaacaacttcaccaatcctaaaggtgaggtggttaacataagtgaggctctaaacacgggactgattgatggacgccgtggacaaatcattgatcctcaaagcaatcgttttcttaatttgaggcaagcggtggaacaaaaagttcttgaacccgatcagacgaatcatattctaatgccgttggccaagagct

SEQ ID NO: 541 - DNA, 322 bp, Drosophila suzukii
cggtgggtatgatattcccagtggcagtggaaaagggccttgtggaaccgtcgaagcgtgtggttctgcacccaactacaaggaaagccatttccatcaagcaagccattaaggagaacttcattatgtcgattccctactcaccgaaaccagatgctatagaggtggttactgcgatggagcgagatataatcgatgtggctgcgcagacgctgacagtcccgtccactggggaacgtgtacctctgcgtcaagctatggaaaatggaattttagtagtaaagaatctctccgattttgtcgttacccagaaacccattcc

SEQ ID NO: 542 - DNA, 1030 bp, Drosophila suzukii
gcgaagaatccacaactcgagagaccaaggcggcggcaggagaaagtccggaatcgattgctgcactagccactagcagcgatcaaactgtggtagtggaggagcgcacccagacagtggtggtaagttcggacacacgcaaagaagaattgcaagtagtcagcacaacgcaatccaccaaggaaataccggtttcaatattgagcgaaaccgaaaagaaggaaccatcaaagacgttacagaatgtaagagatgccgccaaaatgggggcactcggagtcatcgcagcccctgtactggccggaggagccatcgtgagtggcgttaaaagcctcatcaagtctgtgaagtctcccacagaagatgccaagtccaatgcgaaaccagagcaacctcagagcagcttcattgaccaggagcgccgcaatatgttacagccacaacaagtgccaagtgacgtggattatcttctcgacgaaacgaataactttattagctccacaactgccaacttcatagccaacgaaaatcagcaggattccaaaaagttaccacatgaagaagtggggcctttaacagttgaatcaacaaggacactgaccaccacaacagttaagaccgtaactacctcaaagacatcatcagagatcgcaaatctagagccagttgtggtggaagatgtcaccgctagcattactgtcgaggagagtccaatggtagaaatggtaaatgaagtatcagagaaacctaagcaagtgttggaagataaaacaaatgcttccaaggtaactgaaatcattaccacagttacaactaaggagacagattgtttgccagaaaaaccatctccaactaaattcacttctgaagagccaacaaagaaggaacccaatgttatgaaagaaccggagtccccgaagcctgttcaaaaagaccgaactcccgactcagctcaaggagaagtatcttcagatgcaaataaaacggactcgacttccgaggtggttaaaaaagagaaaactccagagcc

SEQ ID NO: 543 - DNA, 1472 bp, Drosophila suzukii
agagaaaactccagagccggcccagatcacagaaaaagaaactaatcgtgcatcggccattgaaacagaaccttccccagagaccactacaaaaccagaacccaaaccaagaactggtaaaaaagaaatgcatcccgatatcgagccgcctttcacagcaccacttgcaccatttgttgataaactcactgatacctcgattacagaaaccgaaattaaacccgttgctagttctcaaactataacaactattacaactgtaaaaacaattgaggagcatccaatgattgaggaaggtactgtgactagcaaacctgacatgattgttgatgtgcaagtaaaggaaccagccgtccaagagccttccaacatggataagccaagtgatatcactaagaattcttttaagcctgaacacaccagtacaacagtgctcaatgaaagcacttttattattgaagacccaattatcacagaatctacagtaacaacaacaactattagaacaaccaccacaggcgctgaggcgaacccgccccacgagcttaaagttacggaggagaaaccggctgcggaggagctagtacaacttatcccagctcagccctcagagacatcacagaaaactagcggtgaagaaagtaagtcagaacacacagacactgagtcgccagataaggagccaatacaagatgatccaactcgacctattgagacatctcagacaattaaatcagtgatcgcaaagacaactgtcattagtgaagaaaatccacaactttcaagtgatcttgagcgtactgttctacctcagcctgcttcggacaagcatcaatcagtagttgatttcattgagatggaaaaaaggccacaagggtcggaaagtagcaccagcattctgcagaacgtcaaggatgctgctaagttaggggctcttgcaattgtgggagcacccgtcctcgctggcaaggctttggtagatgttctaaccacagaaaaaacactcaaaccacaacaatccaatcaattggggcctgagacagtggaagaattgccaacggataacatctccaccatccccgccacattaataacaaaagtcaccactataacatccacctccacaacatcaaccgttgaaagcactcccttagatgagtcccatgacgtagttgaactgcctgctgagtttgcagaaacaactatcaagcgagaagtgcccagaacactgcccattggcgatgccatttcccaaaaactgattagccccgatgagtgtcaggtgatagtagatggagaacaacagtctcaaactgtttccacgctgctcaaggaggagcagctgagtccattagacgaagtgcagatcattgacgacaaactgattgtactgcatcaggtcacctacctggtggacgccgacaccgaactgacgcccgaaaatctgggcgagcttaacatctacgatcccg

SEQ ID NO: 544 - DNA, 213 bp, Drosophila suzukii
ccggcaaatacgagactctcactgcagctttggaacgtcctcttctggacaggcacactggtcacatggtcgatcccaagacaggcaagaaaataccattctttgaatgcattgctcgccaatggatcatccgtgcgaaacccgaggagcagcgacaaccaggcattgataacgtaacaatagacacacaaaccggacaggtggtgcttgacg

SEQ ID NO: 545 - DNA, 258 bp, Drosophila suzukii
ccattgaaatgggctttgtagagctggagacgacgttggtcaaggatgccgatcacgacaagattttgccgggcaaagaggcagcaaaggtgggtcttctggacacggttcgtggtaccctaagctcgcccaacatcagtctcgatgaggccttcgttaagggctatctcattagcaccaagaagccactgtctctagtcgattgtctactgcgtggtctctacgatccttcgacagctaaattcaccatcgacgaca

SEQ ID NO: 546 - DNA, 333 bp, Drosophila suzukii
tcaccatcgacgacaagcaactggacctgaaatctgccatttctcaaaagcttatcaatcctgaggagcttgtgctactcgacccaaggacagagtccattatttcgattaccgaagctatagcaaagggttacctcgatcctattgctggatatgtggttaatccatatgcttccactaagttgtccctccacgaagctctcgagaatcgcattctcattccgccaaagcgcaagcgcagcctgccggatgccgtctaccgtggtctttacgatcccaagacaggccagttcagcaacacggtgacccgcgagaagctcacaactgaacgtg

SEQ ID NO: 547 - DNA, 261 bp, Drosophila suzukii
ttggggtagccaccgagacgggaatagtggacagtaaacaaggtacggtgagggatgtcgatgacaatgccattgactttaaggaagcttttgatagaggtattttagtggaagccaaaaaaccactgcgccttattgaagctgttgtaaaaaatgtttacgatgaggtagatggacactttgtcgaccccaagtcgggcgaaaaacttagctttgccgaggccttaagcaccaatctactagacgagcatagtgtgcaga

SEQ ID NO: 548 - DNA, 200 bp, Drosophila suzukii
ccagaactggtcgccagatcactctgctcgagagcatgcgcagtttcgtgatcaatcctcacctgccatgctactttgatgagcacacggaacagatgttcacgctgagtgagacttgtcgtaatggtatcattaatagaagggagggtgtctttcgggagccgggaagcaatagctttgtccctctgggcgaagcattg

SEQ ID NO: 549 - DNA, 466 bp, Drosophila suzukii
cctctgggcgaagcattgagcctgggtctaattgtggacattgagaacgccggctttggtctgtacgaactactatccatgggcttctatgacattctcacgagaaaggttctgcatccggttacaaatcgcaagcttgatcttaacgaagcatgtgtggaggatgtggttagcttatcttccagtttggtcaaacaccacgagactggaaagtaccttcgtctggctaatgcaatcaaggaacaattgatagatgactcaaggggttgttataatataggtggcgagcacttggacttgcaggtagctagggccagaggtttaattgtctccaatcgtcgccttcttagccttgaactcgtgttgcgccagcagctttatcggcccgatactggcaagttctgtgatccgaccaccggggaatatctcgacctaatcgaatccattcattcgggtttcatagatc

SEQ ID NO: 550 - DNA, 207 bp, Drosophila suzukii
cgcccaaggtatacacgctaaaggaagccgccagtgcgggcgttgtggatcccgactccgcgctggtcaaggatctggctaaggccaagctcgtccgtttgccggaagcattccgcaagggtttgatggatgcgaacaaggcgaatgtgctcaacactcagacctcaaagctttgcaccctgcaggaggcctatgagagtggcctga

SEQ ID NO: 551 - DNA, 301 bp, Drosophila suzukii
tgggtggacgccagcgtgaataccaggatgccttggacaaggccaacgagtggctaagaagtgtgcatccacgtgtttcgcgcattatctccgagccgattgccggcgacccaaaggcagtgcaggatcagatgaatgatgcaaaggctctgcacaacgagctgctctccagtggtcgtttggtggacaacgcacagcaggcccttgataatctactgcgaagccttggcggtcaactaagtcccatggaaattaatcagttggagctgccaattgctgatctgaagaacaattatcagca

SEQ ID NO: 552 - DNA, 243 bp, Drosophila suzukii
tccgcgagcacaaggtcctcctcgccgatcttcaatcccaccaggccagcattgacagcgttcaaatctcggccaagcatctgctagccagcgcttcgaatgcccgcattgccaagaaggttgagtcgaatctaaatgatgtcaccgtcaagttcgagaagctgtatgagaaagccaacaagcgtggcgagttcttggacgacgtttacaaccggctaagcaggtatctggatgaaatcagca

SEQ ID NO: 553 - DNA, 504 bp, Drosophila suzukii
atctggatgaaatcagcactgtggagcagcgcatggccagtttgcaggagggtctcgatagtcgtgagacaagcctgcttcccaccgaggagctggcccgccggatgcacgaactatcccgcgataaagatcaactggcaccgcagtttgaggattgtgtgcgtaatggcaaggagctcatcagcctgcgtgatgttactgacaccggagtacttcgtgatcgcattaaggcacttgaatctcagtggcgtaacattaacataagcattgatgagcgcgccaagttgtccaaacaaaaggccgaacagcaactggcgtacgaaggcctgaaggatcaggttctctcatggctagccagcacagaggcacgcgttaatggccttcccccggtcgctatcgatctggaaagaattaagcagcagcatgatgagctaaagccaatctgcaaagattaccgcgactatgctccaactattgacaagatcaacgatattggagcacagt

SEQ ID NO: 554 - DNA, 252 bp, Drosophila suzukii
gaagcacttccaggagctgggacacgatgtggtcgaccatttggcaggcacacccgatgcccaagctgtcgaactgaaactgaaggacatccttggcaagtgggaggatctggttgggaagctagacgaccgtgccaacagtttgggcggcgccgctgatagttccaaggagtttgatgcagccgtcaatcgtcttcgtgaggctctacagaacatcagcgacaacttggatgctttgcccacggatggcga

SEQ ID NO: 555 - DNA, 213 bp, Drosophila suzukii
aggtttggaagcattccggagagttcgagaacacaaagggtttgggcgagacgttcctcacaagctgtgacatcgataaggaacctattaaggcggagctgcaggacattcgagatcgctgggagagattaaacaatgatttgattgcccgagctcatgagattgaaaactgctcacgtcgtttgggtgatttcaatgatgagttgcgaaacc

SEQ ID NO: 556 - DNA, 271 bp, Drosophila suzukii
agcatcgttctatcaacgacgatatttccagtcagaaaggacgtgtgcgtgatgttacggcgtcctccaaaaaggtgctccgtgaatcgccacagagcgagaatactgctactcttcgtgaaaaattggacgatctcaaagagatcgtcgataccgtggctcaactgtgcagcgagcgtttaggagttctagagcaagctctgcccctgtctgagcatttcgccgactcccaccaaggacttaccgcctggctggatgacatggagcagca

SEQ ID NO: 557 - DNA, 267 bp, Drosophila suzukii
agagtgctctgcaggaatctagccagttctccgataagctggagggcatgctgcgagctcttgccaataccgtggaccaggtcaatcaattggatcccctgtcagccctgccgcagaagattcgcgagcagatagaggataatgatgctttaatggacgatctagacaagcgtcaagatgccttcagtgcagtacaacgtgcggccaacgatgtgatcgccaaggcgggtaacaaatccgatcccgcggtgcgtgacattaaggcca

SEQ ID NO: 558 - DNA, 264 bp, Drosophila suzukii
aacgcacttcacccgagcaggcagcatcgattcgcgaacccttgtcggtagtcaatcgacgctgggaagcccttctccgtggaatggtcgaacgccagaagcaattggagcatgcactcttgcacttgggccaattccagcatgcgctcaacgagctgttggtctggatcaacaagaccgacggtactctggaccaactgaaaccgattcctggagacccacaactgctcgaggttgagttggctaagctaaaggtgctggcca

SEQ ID NO: 559 - DNA, 210 bp, Drosophila suzukii
ccaagaatgcccctgatgatgagaaggtgtcgcgcgaaatgatggatatccacatggagtttatgaaagacctccgggtgcgcgagcgcgaaaagaccgagacgttcgagtacgctgaagacatcatcaataaggcctatcctgatgccatcccgattatcaagaactggctgtcgatcattcagcagcgctgggaggaggtgcgccaat

SEQ ID NO: 560 - DNA, 224 bp, Drosophila suzukii
acatggctccacgctgtcgttggatagcaccgacgatcacacgccctctcgcattccgcaacgcaaaccatcgacggccagcaccgccagcggcaccacgcctcgtccggcgcgtctttcggtaaccaccactgcgactcccggaagccgtctcaacggcaccagcaccatcacccgcaagaccgcctccggatcggccagtccagcgcccacaaggcgaaaca

SEQ ID NO: 561 - DNA, 202 bp, Drosophila suzukii
ggcgaaacatcagcggtagttccacgccctctggcatgcagacgccgcggaagagttcagcggagcccactttcagctcgacgatgcggcgcacttcgcgtggaacaacaccaacggagaagcgcgaaccgttccgcctgtaagaacgcgacctcacagatggggatgacaatagagaagcagagaatgccaatatttaaac

SEQ ID NO: 562 - DNA, 253 bp, Drosophila suzukii
gaggagcagcagaggatcggcaagtttgcccacgaaaacggcattgctttgatcatcgccgagacgcggggactgtttgccaaggtgttctgcgactttggcgataacttcaccatctacgaccaggatggcacccagccggtgtccaccatggttgccagcatcacgcacgacgcccagggagtggtcacctgcctggatgagacccgacatggcttcaacgacggcgactatgtcaccttctcggaggtgc

SEQ ID NO: 563 - DNA, 285 bp, Drosophila suzukii
cggaagtgaatgtcaccgcctatgagctgcgtgtgggcgccgaaacggagaaggtgttctccgaagacttctttggcaaactacacggtgtagccaatgctttggacaacgtggatgcacgtatctatatggatcgcaagtgcatcttcaaccgcatcccgctggtcgagaccggaacactgggaaccttgggcaacgtccaggtgatcgtgccgttcgccaccgagtcgtacagctcgtcgcaggatcctcccgagaagagtatacccatctgcacgctgaaga

SEQ ID NO: 564 - DNA, 257 bp, Drosophila suzukii
ggcggctgccagtaaaccaacatcgcgcaatgccctcaagctgggcggcaagtccaaggacgttgacagttttgtggatcagctgaagagcgagggtgagaagattgctaatttggcaccggcggcgtccgcaggaagttccagtgctgcagccagcgccagtgcagcagccaaggcagctatttcggcggatattcacaaggagagtgtgcatctgaagatagaggacaagttggtggtgcgtctgggacgcgatg

SEQ ID NO: 565 - DNA, 214 bp, Drosophila suzukii
aggcggcggtcaagtattcgagcgaatccattctcttcgtggagaagcccactgtatgtcgtatttttgctctggaccttttggtattcctgaccttttccgtgttcggtcacactagccattgttttggttattttcttgctttgtttcttttcactgcacttggtgttctacgttgcgaattaaaagcctcgcccatggagcagcaactgga

SEQ ID NO: 566 - DNA, 279 bp, Drosophila suzukii
cggagcagtttgacctggtggtcataggcacaggtttcaccgaatcctgcatcgcagctgcggccagcagagtaggcaaaacggttctccacctggacagcaatgagtactacggtgatgtgtggagctccttcagcatggacgctctgtgtgcccgtttggaccagcagcccgaagcccattccacactgcgaaacgccagttacacctggcacaccacggaacaagaaccagaatcaggtgaacccacttggaccaaagactcagtgctggccaagt

SEQ ID NO: 567 - DNA, 282 bp, Drosophila suzukii
actcagtgctggccaagtctcgtcgctttagcctggatctctgcccacgcatcctctatgccgctggggagctagtgcagctccttatcaagtcaaacatctgccgatatgctgaattccgggcagtggaccatgtctgcatgcgccacaacggtgagattgtctctgtgccttgctcccgcagtgatgtcttcaacacaaagacactgaccatcgtggagaagcggctgctgatgaagttcctcacagcctgcaacgattatggcgaggacaagtgcaacg

SEQ ID NO: 568 - DNA, 215 bp, Drosophila suzukii
ggtctctgcccctggctatccaccagtatcaaaaggcattgagttgaagccccatatctctcggggcttgttcatatcgtcaagtcccttgggcaacgaggaattgaataagggaggcggaggcgtgaatcttctccgactgctcgatgccgatggggcacgggaagccttcttaattcaactgtcgcattacactggagcctgtcccgagggtt

SEQ ID NO: 569 - DNA, 306 bp, Drosophila suzukii
atccggatatccgcgagaagctcttcatagccgctaaggagtcccacggaaactacctgaaccgcaactgcattacgagtagccacaataaccaggtcagcgattctgaggcgaagggcaagaagcagccggacagcatcctcatagacgatattataaacaactactataaccaccgatccaaacggcaccatcatcagtacgagaacctgcatcacacgagtaatggttgccaggtggaggaggatgaggaggcggcccagcatttggtgtggtgtgccgcggattcgcagtccaacttcagtt

SEQ ID NO: 570 - DNA, 493 bp, Halyomorpha halys
agcagaaaaattgaaacaaatgcagactgaagttgataagcagatgaatcttggcagcccgccatccacgataccaggtgggttgaatttgtcatttgaagaaaaggtggaagtggataatcggtccatttatgtaggaaatgtagattatggtgctactgctgaagaactggagtcacatttccatggctgtggatctattaaccgagtaactattctctgtaacaagttcgatggtcatcccaaaggctttgcttacattgaatttgctgacaaagattctgttcaaactgcaatggcaatggatgagtcattatttcgtgggaggcaaattaaggttaatccaaagagaactaaccgtcctggattgagtacaacaaacagaggatttcgaggcgcccgaggaagaagcaggtatgcacgaggtgctttctatggtttcacaagatcgaggagagcaagagttttccgtcgaccttattatatgccatac

SEQ ID NO: 571 - DNA, 427 bp, Halyomorpha halys
gattggatgataaagttactgaaactcttatgtgggagctatttgttcaagccggaccgttcgaaaaaacacttatagcgatcaatgttcacatgccaaaagacagagtgacacaacaacatcagggatatggattcgttgagtttttgggtgaagaagatgctgattacgctataaaaattatgaacatgataaaagttcatggaaaacctattcgtgttaataaggcttcagctcatcagaaaaatttggatgttggagctaatgtgttcattggtaatctggatcctgaggttgatgaaaaattgttatatgacacattttcagcgtttggagttattctgcagacaccaaagatgttttattactattcctatataactctttttgatactttgacattaagtgaatttatttttaaatgttt

SEQ ID NO: 572 - DNA, 285 bp, Halyomorpha halys
tttatttttaaatgttttttttttaatatttatttattgctatttacaactgtacattataatacattgagtaaatttgacttagttaaaatggagagttacaggcgtgtagagcaactacccattggtagcactctaatgacattttacattagctggtctcgtggccatcttcttttcaggcgcctcagaggattgtcaggaatagaagaggatgcaagattccaaactataacttatattaaaaaagtgtatcaaagttataaaatgtgtaatattatctat

SEQ ID NO: 573 - DNA, 948 bp, Halyomorpha halys
ttattcaagaatcaggagacttaaaagaagcattaaaccatttaactgagtgtcaaactcagatatgtgataggttgtcagttgaagaaacatttgcattattatatttgaatttgaataaatttcaagaagctgaagctgttattcgtaatttattgaaaaggaatcctgaaaataccttatattatccattactcgagagggcattgagaattgagaaagatgaagacaaatttaatttactgatggaacttgtaaaagctgagcctaaagccctagctcctagaagattgttgttaaattatgctacaggagaaaaattcatttttgaaattgataaatacttaaagaagggtctaagaaaaggaatacctcccctctttgtggacattaggggattatataaagataaacacaaagcaaatataatagagaatctcgttcttggatatgcaagatgtcttaaaacatttggaacctttggaaacttagaacataaagaacctccttctgcattattgtggacttactattttcttgctcaacattatgatcactttagaaaacttgataaagctcttgaatgtattaacgaggccatagatcacacaccaacattgatagagttgtttattactaaagctagaatatacaagcatgctggtgatgtgtatgaagcttaccgttgggtagatgaagctcaagcccttgatactgctgatagatacatcaattcgaaatgtgcgaaatacatgcttagggcaaatatggttaaagaagcagaagagatatgttctaaatttactagggaaggtgtttcggctatggagaaccttaatgaaatgcaatgtatgtggtttcaaacagaatgtgctctagcttataaaagactagaaaattggggtgaggcattaaaaaaatgtcacgaggttgacaggcatttttctg

SEQ ID NO: 574 - DNA, 203 bp, Halyomorpha halys
aaattgttgaagatcaatttgactttcatacttattgcatgagaaaaatgacattaaggtcatatgttggccttttaaggcttgaggatgttctccgatcccacaaattttttcaaaaggctgctagctgtgcaattaatgtctaccttcatttacatgatgttcccattaaggatcaaaaacatgaggaacaaatgaaatta

SEQ ID NO: 575 - DNA, 285 bp, Halyomorpha halys
atgtctcataggaaattcagtgccccccgtcatgggtctatgggcttctaccctaaaaagaggtccgctcgccaccgtggtaaggtcaaggcattccctaaggatgatccttcaaagcctgttcatcttactgcattcgttgcatacaaggctggtatgacacatgttgtcagagaagcagatcgaccgggttcaaaaatcaacaagaaggaaattgtagaaggtgtaactattttggaagctcccccaatggttgtcattggtgcagttggttatattgaaact

SEQ ID NO: 576 - DNA, 362 bp, Halyomorpha halys
ttggttatattgaaactcctcgtggattacgtggtcttgtgactgtatgggctgagcatatcgcagatgaagcaaggaggaggttttacaagaactggtacaaatccaagaagaaggcatttgtaaaggctagcaagaaatggagcgatcctcttggtaagaagcagattgaagaagacttcaaaaagatgatcaagtactgcaaggtcatccgtgtcatcgctcatacccagatgaaactgttaaaacaaaggcaaaagaaagctcacattatggaaattcaagtaaatggtggaactatagctgataaagtagcttgggttcgagaacatttggagaaacctgttcctgtttctggagtt

SEQ ID NO: 577 - DNA, 239 bp, Halyomorpha halys
gttcctgtttctggagtttttgctcaagatgaaatgatagatgtgattggagttactaaaggaaaaggatttaaaggtgttacttctcgttggcacaccaagaaactccctcgtaaaacacataaaggtttgaggaaagttgcttgtatcggtgcttggcatccttcaagagtacagttcacagttgccagggctggtcagaagggttatcatcatagaacagaaatcaacaaaaaaat

SEQ ID NO: 578 - DNA, 264 bp, Halyomorpha halys
ggtgaagtaaataatgactaccttatgatcaaaggatgttgtatgggtcccaagaagagggttatcactctcagaaagtcacttcttgtgcacacaaagagggtagcattggagaagatcaacctgaagtttattgatacttcgtctaaatttggtcatggtcgtttccagacccctgcagacaaggcttcgttcatgggcgtaatgaagaaagacaggttgaaggaagaggctgcacagacagcagctgcagccgccacagca

SEQ ID NO: 579 - DNA, 292 bp, Halyomorpha halys
atggatcgtcttttgcgtttagggggtggaatgcctggattgagtcaagcaccacctccatcagatgctcctgttgtagatacagcagagcaagtctatatttcttcactggctctacttaagatgttaaaacatggtagagctggggtgccaatggaagttatgggacttatgttaggagaatttgttgatgactacactgtaagagtaattgatgtgttcgctatgccacagactggaacaggtgtaagtgtcgaagctgtggatccagtttttcaagcaaaaatgttag

SEQ ID NO: 580 - DNA, 410 bp, Halyomorpha halys
ttcaagcaaaaatgttagacatgttaaagcaaactggtcgcccagaaatggtggttggatggtatcactcccatccaggatttggatgttggttatcaggtgttgatatcaacactcagcaaagctttgaagctctttcagaaagagctgttgctgttgtagttgatccaatccaaagtgtcaaaggaaaagtagtcattgatgctttcagattaattaacccaaatatgatggttcttggtcaagaaccacgacaaactacatccaatttggggcatttacaaaaaccttctgtgcaggcattgatacatggtttaaatcgccattactattccatcagcatcaactacaggaaaaatgaattggaacaaaaaatgttgttaaatcttcataaaaagtcatggatggat

SEQ ID NO: 581 - DNA, 267 bp, Halyomorpha halys
aaaaagtcatggatggatgggctaatgctctctgactattcagacaattgtaaagttaatgaaactactgttggtgacatgcttgaattagctaagaattataacaaggcattggaagaagaggagaaaatgacacccgaacagttggccataaagaacgtaggaaagcaagatccaaagaggcatttagaggagaaagttgatgtactgatgtcggccaatatagtgcagtgtcttggtgctatgctagatactgttgtgtttaaa

SEQ ID NO: 582 - DNA, 322 bp, Halyomorpha halys
atgtggcaagaaatcgaatattttttagacgaaccgacggatgcagcaacaaattctggcggaagttttcaagatttagcaggtgaagaatttttggacttggacgtgctacttaacatagcagctgaagagcatgcagactcgtctcctcccagtccagaacaaggggaagctgaagagaacagaaaaatctgtgatcgaagccgtcaagaaaaatcattaaaaaaatccaacagccatgggtgcttgcatccgggttgtggtaaggtatacacaaagtcatcgcacttgaaagcccatctccgaactcatacaggagaaa

SEQ ID NO: 583 - DNA, 384 bp, Halyomorpha halys
atgtctctcgttttacctgagaagtttcaacatattcttcgtataatgggtaccaatattgatggtaaaagaaaagttatgtttgccatgactgccatcaagggtgttggtaggagatatgccaacattgtattgaaaaaggccgatgtagatttagacaaaagagcgggagagtgctcagaagaagaggtcgaaaaaattgtaaccatcatgcaatatcctagacaatataaaatcccagattggttcctgaacaggcaaaaagatattgttgatggaaaatacacccagcttacatcctccaatttggacagcaaactccgtgaagacttggagaggttgaagaaaatcagagcccacagaggaatgaggcattattggggg

SEQ ID NO: 584 - DNA, 530 bp, Halyomorpha halys
atgatccccagaaggacaaacgtttttcaggcactgttaagctaaagcacattcccaggcctaaaatgcaggtctgtatacttggtgaccaacagcattgtgatgaggctaaagccaataatgtgccctatatggatgttgaagcgcttaaaaaattaaataagcagaagaagttggttaaaaagctggccaagaaatatgatgcttttcttgccagtgaagctctcattaaacagattcccaggcttttgggtccaggtcttaacaaagctggtaaatttcctgggttattatcgcatcaagaatctatgatgcagaagattgatgaagtaaaagctactatcaaatttcagatgaagaaggtactgtgtttgtctgtagctgttggacacgtcggtatgacagcagatgaattagtgcaaaatgtccatctttcagtgaactttttggtttcgttgctcaaaaagcattggcaaaacgttaggtcattacatgttaaatcaacaatgggacctccacaaagattgtac

SEQ ID NO: 585 - DNA, 495 bp, Halyomorpha halys
atgcctccaaagtttgatcctaacgaagttaaaacagttttcttgaggtgtgttggtggtgaagttggagctacatcttctctcgctcctaagattggacctctcggtttgtctcccaagaaagttggtgatgatatagctaaagctacagcagattggaaaggtctcaaaattacagtttgtctcactattcaaaacaggcaagctgctatctctgttgtgccatcagcagcttctcttatcataaaagccctgaaagaaccaccaagggacaggaagaaagtcaaaggagtaaaacataatggtaacctcacttttgatgaaatcctcaccatcgccaggtcaatgagaccaagatccatgtctaggaaactagagggtactattaaggaaattctcggcacatgccaatctgttggttgtacagttgatggaaaaactcctactgaagttatctgccaaataaatgatggagaaattgatgtagcagatgaa

SEQ ID NO: 586 - DNA, 233 bp, Halyomorpha halys
ggctgacgcagcagcccgacagttgcagtatgagtacaaagctaactcaaatcttgttttacaagctgatgtacgactcattgaaagaagaagcagggatgaagctactggagaagttatgtcccttgttgggaaactggatggtactaaaatgggtgataagtttgaacgaactaaaccgataaaaactgaggaaaggaaagtcaaaaggttgaaacgagatgaagctcaat

SEQ ID NO: 587 - DNA, 413 bp, Halyomorpha halys
tgaagctcaatatgattttgctagaatgaaaggtactacattactatccgataatggagatgacatggttggagtagtttataggccaaaaacacaagaaactagacagacttatgaagtgttactaagctttatccaggaagctcttggtgatcaacctcgtgatattttatgtggagctgctgatgaagttttatttgttcttaaaaatgaccagttaaaagaaaaggagaaaaaggtagaaactgagcatcttcttggtagtttagccgatgaacgatttgccttacttgttaatttaggtaaaaagataactgattttggaagtgaggataaagtagctcatatttctgaagaaaatatagatgaaacttatggcattaatgtacaattcgaagaaagtgaagaagaag

SEQ ID NO: 588 - DNA, 887 bp, Halyomorpha halys
gaaagtgaagaagaagatggtgaagacatgtatggtgaagttagggatactgatttacaagatcagaatgacgaaggtgaagatgccaaacatcatactgctattcatgctgaaaatctgggtagtcatgaagatacgtctaaaaaagaaaaaggactgcatccattagacatagatgcatattggttgcagcgaaggctttcgaaattttataatgatgccatgacttctcaggcaagggcagctgaagtcctgcaaatacttggtgagacaactgatgatcgagaatgtgaaaatcagttagttttattattgggttacgaatgttttgattttataaaacttatcaaaaagcatagaaaaatgattttgtattgtactttgcttgcctcatcacaaaatgaaaatgaaaagaccaagatcagaaatataatgcaaaatgatccttctctcttgaaaattttgaaacaacttgaagtaggaaaagttgaagaaaatggagattcagaaaatattaggtcctcaagaaggaaagaagtaatttcacattctacatcagtggagggtatggttcctggtacaagggatgttttagatttggatgacctctcatttgcccaaggatctcattttatgtcaaataaaagatgtcagttacctgatgggtccttcagaaagcaaaggaaaggttatgaagaggtccacgtacctgctttgaaacctaaaccttttgaccctaatgaggaacttgttcccattgataaattacctcattatgttcagccagcatttgatgggtttagaaccttgaatcgcattcagagccatctttacaaagcttgccttgagtctgatgaaaatctcctgctttgtgcccctacaggagc

SEQ ID NO: 589 - DNA, 244 bp, Halyomorpha halys
gtgcccctacaggagctggtaagactaatgttgctcttctttgtatgctgcgagaaattggaaaacacattaatgaagatggtacaatcaatgcagaagaatttaaaattatatatgttgctccaatgagatctcttgtccaagaaatggtaggcagctttggtaagcggctttcagcttataatctaacagtgtcagaattgactggtgaccatcaacttacacgagagcaaataaatgcaac

SEQ ID NO: 590 - DNA, 476 bp, Halyomorpha halys
tattgttgatgaaattcatttgcttcatgatgagagggggccagtaattgaagctttagtagcaagaactattagaaatattgagtctactcaggaagatgttagaatcattggtcttagtgcaacattaccaaactttcaagatgttgctacttttctcagagtacatcctaaaacaggtttacatttctttgataacagtttccgtccagttcctttagaacagcaatatattggaattacagagaaaaaggctctgaaaaggtttcagataatgaatgacattgtttacgaaaaagtaatggaacatgcaggtcgaaatcaggtacttatatttgttcattcaagaaaagaaactggaaaaactgctcgtgcgattcgtgatatgtgtcttgagaaggatactttaggtcaatttttaagagaaggttcagcttctatggaagttttgagaagtgaagctgaacaagttaaaa

SEQ ID NO: 591 - DNA, 312 bp, Halyomorpha halys
agctgaacaagttaaaaatagtgaattaaaagatttgttgccgtatggctttgccatacatcatgctggaatgtcaagagtagataggactcttgttgaagatttgtttgctgacaggcatattcaggtccttgtatcaactgctaccttagcttggggtgttaatcttcctgctcatactgtaattattaaaggcactcaagtttacaatgctgaaaagggacgttgggtggagttgagtgcattagatgttctacagatgcttggtagagctggtaggccacaatatgacaataaaggagagggtatatt

SEQ ID NO: 592 - DNA, 849 bp, Halyomorpha halys
aaaggagagggtatattgattacaaatcatagtgaactccagtattacctatcattattgaaccagcagttgcctattgagtctcaacttattactaaactccctgatatgttgaatgctgaaattgtattaggttctattcaaaacatgaaggatgctgtaaaatggttaggctatacttatttatacattagaatgttacggtctcctgcattatatgggatttcttcagataaattgatgcaggataagttgttagaacaatttagggcagatttaacccatactgcgtcgatacatttagagaagagtggtatagttaaatatgacaagagatcaggttattttcagtcaacagaacttggtcgtattgcaagtcactattattgtacttatgataccattgctacttataacatgctattaaaacctactctcagtgaaattgaactgtttagagtttttgcgatgtctggtgaatttcgaaatattacagttagagaagaggaaaaattagagctacaaaaactaatggaaagagttccaataccaatcaaagaaagtatggaagagccttctgccaaagtgaatgttcttttgcaagcttttatttcacagctgaaacttgaaggatttgcgttgatgtcagatatggtatatgttactcagtcagctgctagacttatccgagctatttttgaaatagtattgtacagaggatgggcacaacttgcagaaaagactctttccttaagtaaaatgattgatcgaaggatgtggcagtccatgtctccattacgtcagtttaaaaagatccctgaagaagttttaaagaaaatagaaaagaaa

SEQ ID NO: 593 - DNA, 260 bp, Halyomorpha halys
aagaaaatagaaaagaaaaatattccatgggaaagattgtttgatctaggacctaatgaaattggtgaacttattcgtattcctaaacttggaaaaactattcatagatacattcatcagtttcctaaactggaattatctactcatattcagccaataacaagatcaacattaaaagttgaattagtgatcacaccagacttccaatgggatgagaaggtgcatggagtgtctgaaggattttgggtcatggtggaaga

SEQ ID NO: 594 - DNA, 1592 bp, Halyomorpha halys
ttgggtcatggtggaagatgttgattcagaagtcattcttcatcacgagttctttttgttgaaatccaaatattgcaaggatgatcatcttataaaattttttgtacctctttttgaacctgttccacctcagtatttcttgagagttatttcggatcgttggattggatcagaagcccaacttcctatttcattccgtcatttaatactaccagaaaaaaatcctccctccactgaacttctagatttacagcctcttcctgttacagcattgaggaatgttcagtttgaacagttgtattcagataagtttacccaatttaatcctatacaaacgcaggtgtttaatgcggtatacaacagtgatgagaatatttttgttggtgcaccacatggatcaggtaaaacagtaattgccgagtttgccattttaagaatgattactcaagatactgattttaggtgcttgtatataactgcaaaagaagctttggcacagattgtctatgctgaatggcatcacaaactaactccattgattggtaacagggttgtactattaacaggtgaaactgcaactgatctgaaacttgtttcaaaagggatagtcattattgcctctgctgaaaaatgggatgtcttatccaggaggtggaaacagaggaaaaatgtccaaaacatacagttgttgattgttgatgaccttcagttgctagggagtgatgatgggccagttttagaggttgtatgctcccgaatgaggtatatcacatcacaaattgaaaaacctttaagaattgttgcactttcgtccccattagttgatgcaagagatgtggcccaatggttgggttgtggaagtaattgtaccttcaattttcatccaagtgttagaccaataccacttgaacttcatgttcaagggtttaatataactcacaatgcttctcgattgattgctatgagtaaaccagtatataatgccattttacatcatagtccacataaaccagttattattttcgttccctcaaggagacaagcaagattaacagccattgatttattaacttacactgctgctgaagctaatcctacaagattttttcatgctgatcaagaagatattgtaccattccttgaacgaatgagtgataaagcattaaaagaaacattacctcagggtgtagcatacatgcatgaaggtttatcatacaatgatcggagattagtagaacagctctttgattctggggcaatccagatagctgtggtaacaaggaatttatgcttttcattaaatataaattctttccttgttatcgtaatggatacccaattttataatggtaggatccatgtttatgaagattatcccattacagaagtacttcacatggtaggacgtgccaacagacctttagaagatgaagattcaaaatgtgttgttatgtgccagagttccaagaaagattttttcaagaaatttttgagtgaacccttacccattgagagtcatttagatcataagctgcatgatcattttaatgctgaaatcgttacaaaaacaattgaaaataaacaagatgcag

SEQ ID NO: 595 - DNA, 213 bp, Halyomorpha halys
aagatgcagttgattatctgacatggactttactttatcgtaggttaactcaaaacccaaattattacaacttacaaggtgtaactcatagacacctatctgatcatttgtctgaattagttgaaaatacattatctgatcttgaacaatctaagtgtataactattgaagatgatatagatacaaatcctttgaatcttggaatgattgcag

SEQ ID NO: 596 - DNA, 705 bp, Halyomorpha halys
atcttggaatgattgcagcctattattatatcaattatactacaatagagctttttgctttatctctaaccagtaaaacaaaagtacgtggtctcctggaaataatatcttcagctgccgagtatgattctgttcccatcagacagaacgaagacattctcttagaacctttgtccttaaaagttccttacaaaatttcaccagctgccaagttcaatgatcctcataccaaagcaaatcttttgttacaagcacatttatctaggctgcaagttggagcagaactacaaggtgatacagatgctattttaggaaaatctattagattaatgcaagcttgtgttgatgttttaagttcaaacggttggcttgcacctgctgtcgcggctatggaactggcccaaatgataacccaagctatatggtccaaagaatcatatttacgtcaacttccacattttacttctgaattaatcagaacttgtcaggaaaagaaagttgaaactgtctttgatttaatggaacttgatgatgaagatagaaacaaacttcttgggttatctgagtcacaaatggctgatgtagctaaattttgcaatcgttatcccaatatagaactcacatatgaaattgaaaacaaagacaaaatcaaatcaggaagcctcgtgaatgttattgtaaatttagaaagagaagatgaagtta

SEQ ID NO: 597 - DNA, 1134 bp, Halyomorpha halys
atgcctgaaggaataactagagctgatattttctttacactccttagagtgtcattgttttctgttacggctttgttgacagctaagctgttgatgaagcaccttgatccaactaataaaagaaaaacctatgcagcaaaaacggctacggatcttcttgaccggctagggataaaaattgccaaacaacttacagaatatgaattgatgattgctaatcatcttgtcgatccccaaagtattgcagtctcatgggatagtataggagggctaggacatgttattcaagaaattcaggaaactgtcatattgcctattagaagaagagaactattcagcaattcacagttgacccaacctcctaaaggagtattattacatgggccaccaggttgtggaaagacaatgatcgctaaagcgactgccaaagaggcaggaacaaacttcattaacttagatctatctatactcacagataaatggtacggagaaagtcagaaattagcctctgctgtcttctcattagcagttaaactgcaaccttgcataatatttatcgatgaaatcggcaagtttatattttattttatgtattcatttctcagaagccgcaatgtacaagatcatgaagctacagctatgatgaaagctcagttcatgacattgtgggacgggctgaacactgatcctggaacaactgtgatagtaatgggtgcgacaaacagaccccacgatttggataaagctattcttcgtcgtatgcctgctatattccacattcctcttcctactcttgtccagaggaaagatatattgaatcttgttatgtctggtgaaccactagctgataatgttgacctgagcgctatagccgcacacactgaaggcttctctggatcagatctcaaggagctgtgtcgaaatgcttccctttatagagttcgtgattatgtggcaaacactcagttctctgagaaattgaaggaaagaagtgtcaattcgagtacaatgaagctgagtgaagaccaagaagaattccatgatacactacggcccattacaatggatgaccttacaaaatctttaaagaaaatgagagatgctaaagtcaatacatcttctttaactcttgat

SEQ ID NO: 598 - DNA, 963 bp, Halyomorpha halys
atgattattttagaaatcaaaaactggaaagcagcatcggttagtcgaacagaggcagctcatcgttcctcttctacagatgattgttcaaagtttcaaggttattcagcaacttgtgaagcatatgtggtgaacatgaaccaagaggagtgttcaagtccagttgaaccatgtcttaacacacagaatgggttaactaaagtcgaaaggccatataaatgtggtaactgtgaatatagagcaaagcgaaacgacaccttgcgaagtcatgtgaaggcagtccatttaaagttgaaaccttatcactgcagtttatgcgcctatagagccgcacggaaacgtaggttagaagaacacgtgcaagttattcattttagcgagaagactctaatgtgcccggaatgtgaatacaccgcagtattacccgaagcaataagaaaacacgtaaaatttgtgcatatgaaattaaggccgcataaatgccccgagtgtgattacaaggctgctctaccgtcagctttgaggatacacctcaaagtgatccacttaaaggaaaacgatgagtgcccagactttggctataatgttgagccttttcacgaaaatttcggtcacgaaggtatataccgaattcaacgaacaatacctattcaggttcctaagcttcacgtaggggttcaaatggtagtactcaatagacctttagaaaggttttcgggagttgatatccgcgtaagggtcaatggaggtggtcacgtggcccaaatatatgccataagacaagcgatatcaaagtcgctagtctcttattatcaaaaatatgtagatgaagcctccaagaaagagattaaggaaattctaactcaatatgacaggacactcctggtagcagatcctaggaggtgcgagccgaagaagtttggaggtcctggagccagagcaagataccagaagtcatatcgt

SEQ ID NO: 599 - DNA, 592 bp, Halyomorpha halys
aagattacaagacaatggctgcactgtccaaagcaatcgccaagaacgtcctcttcagccacttggatgagaatgagagatcagatatctttgatgccatgttccccgtcaacttcctgccaggtgagacgatcattcagcaaggcgatgagggagacaacttctacgtcattgaccagggtgaggttgaggtgtatgtgaacagtgagctcgtgacaacaatcggggaggggtcaagctttggagaactggctctcatctatggaacccctagggcagccaccgttaaggcaaagacagcggtgaagctgtggggtatcgacagggactcttatcgtaggatactgatggggtcaaccatccgcaagaggaagatgtacgagggcttcctttctagagtttccattctagaaagccttgacaaatgggaacggctgaccgtagcagatgcacttgaaccagtttcattctctgatggtgagactatcgtgaggcaaggagaaccaggcgatgatttctacatcattgttgaagggactgccttagttctgcagtgcaggggggaaggtgatacagccatcgaagtgggcaa

SEQ ID NO: 600 - DNA, 211 bp, Halyomorpha halys
agccatcgaagtgggcaagctcgggccctctgactactttggtgaaattgcattgctattggatagaccacgtgctgcaacagtttgtgcaaagggacctctgaaatgcgtaaaactggatagagcaagatttgaaagagtactcggaccatgtgcagacatcttgaaaagaaacattacccagtacaacagttttgtctccttatcagtc

SEQ ID NO: 601 - DNA, 693 bp, Halyomorpha halys
ctggtgcaaaggggaatggccgtatttatgttgaacatctgcaaatttaatgattgtggccttacttttcagaatttaggagatttaatacaacatatagaagataatcacatcgactacgatccccaggttatcgaagagaaagagcaagagcaaccctcatgcctacctttgagttatgtgcttcggtttttcaccgatgcggcccgaaaagaagttctaagcctaaagccaaaattaaaatcaattgtggagaaaccagctactcaactgccagtacaaacacctatttcaaatggaaacgaagctgatgatgtatttagtgaatcagaagatagtaatgattcatggagtacacaggaagaatttagttcagaatttattttaaaatatggaagcaagatggttagccctactacactgcctgatggaactgtgattgagaagccttttgcatgccctgttcctggatgtaaaaagcgttataaaaatgtcaatggtatcaaataccattcaaaaaatggccataaaaatgaaggaaaaattcgaaaaggcttcaaatgttattgtggaaaaagctacaagaccaatggaggattaaagaatcacacggctttaatgcacagcggtactacaatgactacaatagccactcagaatggaacgccacaagtattgcagatcccaacattg

SEQ ID NO: 602 - DNA, 201 bp, Halyomorpha halys
ttgcagatcccaacattgcagcctattcgaacactaacactaaaacatatagcaagtttaggattaccagtaaaaaccctagtcgtcgccactaagtcacaagacaaaacagctaaaacaactagcagtttaggagttttaactcctgcaacatcaccagattcaccagagaagcctcctgagatagttttatctgataac

SEQ ID NO: 603 - DNA, 390 bp, Halyomorpha halys
atggtgcgtatgaacgttttgagtgatgctttgaaatctattaataatgctgagaaacgaggcaaaaggcaagtcctcatcaggccttgttccaaagttataatcaagtttcttactgtaatgatgaagaaaggttatattggcgaatttgaaatcgtcgatgaccatagagcaggaaaagtagttgtaaatctcaatggaagattaaacaaatgtggagtaatatcccctaggtttgatgttcccattggacagattgaaaaatggacgaacaaccttctgccttcaagacagtttgggtatgttgtattaacaacaagtggtggtattatggaccacgaagaggctaggcggaaacatctgggaggcaaaatattagggtttttcttt

SEQ ID NO: 604 - DNA, 3018 bp, Halyomorpha halys
attaatggttattttattgtctttttagataaacgggaggataaagtagtggtggtagacccctctaaaaaggttaaaagatatgatgtttctagtaagataactttacaacctactgcagaagatgactttgctgattacacttgtgaagctaggcatgaagctctgcattcagatatgcctctgagagttactgtccagcttagtgtattgtatccacctggacttccttatattgacggatatacagaaggtgaaacaattagacgtgggcaaaacgtggagttagtttgcaggtctcgtggtggtaatcctcctgctcaactgatttggtacaagaacagcgaacagatcagaatggcctacaggacctctggcagactgtctgaaaatatttattcttttactgcagatgctaatgacaataaagctaaatatcgatgtgaagcttctaatattatgagtaaatcgcctttgaaagctgaggtggatctaactgtattatttgctcctacacaggtcactatttctggccccactgaggcaagggttggagacactgtacctttgacttgcacgactgccagcagtaaccctcctgccgatatcaagtggatggtcaatggtaggcaagtcaggaatgctacacagcacaccatcccagctcctgaagggggatggttcaccacctccaacactactgccgtcataggtccaaatcagaagtcactcgttgttatctgtcacggattgaacaagcaattaactgaaaatattgtcagcactcacaccatcaatgtcttatatccccctggtcagccgattcttacaggatatacaaaagggattcacattgctgctgggactttacagaaaatatcatgtatttcttctggagggaatcctctggctactctgacatggtataaaaatgacaagaagattaattcagtctcaaaaacaaatgacaggtctgtatctgcagaagtaactatccttgcaaatgtaactgataatgaagctgtttataaatgtgaagcttctaacccagctactgagattcctttaattgaaagagttcagctaagtgtgcatttccctccagaacatgttaagattaaaaaagaaccagaagaacttcgagctggtactatagccaccctcacctgtgatgcaagctcttcgaatcctccttccgagatgtcttggtggcgagaaggaatctctgtaactgaaggaatctctaactccagtaagcctggactccatggtggtactgtgtcatccattcagctgaaattgaacataactccggaaattgatggtgatgtgtacacctgtcaagctgcaaatactgtattacaaaggagtgtccatgatgcaataacaatgtctgttttatataaaccagtattcagtgaagttggtgagactgaagtaagcggaatagagggtgaaaacctactgctgggatcccaagcagttggtcacccctcggcactcacctacacttggactaaagacagagctcctctatcttccaataaagacatccatgttgaaggaccctttattaacttcactcggttgcatagaacattcactggagtctatacttgtgaagctgttaattctgaaggctctactactgttactttcaatctcactgttttctatggtggtagcattgttggtacgagccatggtgtttcagtgtcacctaaggaagatgctcagctttggtgtaggtttgatggttctcctttgtcacaggaacatgttacatggcatagggatgactttcctgaaatgagccaaagaacggcaataacatggcaaaacaatacttcctttttgaccatacatgaagctaagaaagaagatataggccattttcaatgtactattaataacggttatgggaatgagacttcaaagaatgtttttctcattgtcaaacataaaccagaaatggacctctcccctaacttgctcaaatctgctagtaataatggtgaaactggaagacttgtatgcagggtatctgctgcaccagctgtaaattttacatggtctcgaggaagttcaattattactactgatcatcataaatatcttattgattacaaacagattgatgatgttcattatgagtctattgtactcattcgaaacattgagcagtcagattatggtagatacgaatgtatcgctcgtaactatcttggattttcaaccaacacggtcgtactagctttaacaaacgctccagaccccccttctaatcttcaggtatataatgtcagccatgattctttgacacttggttgggaacctggatttgatggtggtcttcctgcatcatacagactgaggtacaggcctgttaacattcctggagctacttacaagtatgaggacacaggaaatgttacaaaatatatggtgacaggtcttgagctgggaacggagtatgtgttcagtattcaagctttgaacaggctaggctctagcagatatcttgctgacaccttaaaggcaacaacttcaaaactgcctgaacctcagttcgatgctgctgatattcctctcatcataataatggctgttgtatcgacagcagccacacttcttatcatcaatatcattgtaattgctttcttttactacagaaagaggcggcatagagatcaggttcatcatgaaggtagcagcgatcaaggtagtaacaaaaacccacctatggaaatgtacgcaccaagcagttataatgaaacagtgactggtgaaactttaagctcagtttcggagaaaagtgagagttattcagatcagcaagactacaatgatgatgctcggaaacctgctgcaagcacttatcttatagatcagagtgattacccattccagtatactgggtatgatattcagccacagatcaaagatgttgagcctattgcactccatagaacaccatataataatcaaaatggaggtaatcattgtattaatattctt

SEQ ID NO: 605 - DNA, 421 bp, Halyomorpha halys
ttggaattagatgatgtgactagtgaaaaacaaatgttaataaaagaacaaggcgcaagtgttgctaaagatgcctcagatgatgttatataccgcattgaagtgcctgcaaatcgttatgatctcctgtgtttggaaggacttactattgccttacttgtctttcaaaacaagtattttacatattatttcatttctaggtttttattgtattatggaattataactgcattgattcatagtcttacaaaaaaaattcgaccttatgctctagctgctgttctcagggatattacattcaccagtgatagttatgctagtttcattgaccttcaagataaacttcatcaaaatttagcccgaagaagaactttggttgccataggaacccatgatcttgatacaattcagggtcctttca

SEQ ID NO: 606 - DNA, 620 bp, Halyomorpha halys
caattcagggtcctttcatctatgatgctcttcctccggatcaaattaaattcaaacccttaaaccaggaaaaagaatacactggccatgaaattatggagttgtatgctaatcatgcacagttgaaacagtatctaccaattattaaagatagtccagtttatccagtaattaaagatagtaatggagttgttttatcattaccaccgataataaatggtcatcattcaagaattactttgaatacaaaaaatgtgttcattgaagtcaccgctactgatcttcataaggctaatattgttttggatactattgtgactgcattttcatatcactgcaaaaatcaattcacttgtgaaacatgtgaagttatttcgccagatggaagtaaacgcagaactccctcattccactacagaaaagaagtgatcaacataaagaaactcaacaaatacattggcattaaggaagaggctggtaaacttgctaaccttctgactcgtatgtgtttatcatcaaaatctacaggtggttctgatattgttgtgaaagtcccacctactcgtcatgacattcttcatcctgtggatatttatgaggatgctgccattgcctatggt

SEQ ID NO: 607 - DNA, 487 bp, Halyomorpha halys
atggcggacacggtgaagaaggaggttaagaagcaagctccagctccacccaaaacagagaagaaagaaggaagtaagacagtaacttcaaagaagctccctgcagtacctgaatctgttttaaaaagcagaagaaggagagatgcatctaaagctgctaagttaaaggcacaacttaagaggaaacttgagaagtacaagaagaggaagttaatcttcaaacgtgctgaacaatatatcagagagtacaggacaaaggaaagagatgagattcgtttggcaaggaaagccaggtccaaaggaaattactatgttcccggtgaacccaaattggctttcatcattaggatcagaggttatttacaatattatttgtttgttagtattaatcaagtggctcctaaggtgcgcaaagtcttacaattattcaggttacggcagatcaacaatggagtttttatgaaactcaacaaggccaccatcaaca

SEQ ID NO: 608 - DNA, 367 bp, Halyomorpha halys
caaggccaccatcaacatgatgcgaatttgtgaaccctatatcacatggggctatcctaatctaaaaagtgtgcgggaattgatctacaagcgtggatttgccaagctaaagggtcagcgtatccctatcacttctaatgaaatgattgaaagaaaattaggtaaatccaatatcatctgtattgaagatcttatccatgagattttcactgttgggcccaatttcaaatacgcttccaacttcctctggccattcaagctgaacacacctactggaggctggcgtaagaagacaaaccattatgttgaaggaggagattttggttgtcgggaagacaaaatcaatgctcttctcaggagaatggtt

SEQ ID NO: 609 - DNA, 1177 bp, Halyomorpha halys
atgagaggacaagttttatctccacaaggattgggaatagttggtatacgtgtgtcagttgatagagactctagatttggattcacacttacgcgtgctggaggatggtttgatgtactggttaatggcggaggagctgtaacattgcaatttcagaggagtccattccaaccaatgacaaggactgtatttgtgccatggaatcagattgtagttctggctcctatttttatgcaactttctgatgaaacagctgagcaattcagggaaaaccaacctcctcctgctctggctcttggcttaggaagtcttgtccacaatttaccttgtatagatcatgatgaaacattgttaatgccagtgatattatcaacttggatgcctgagaaagtgggtggaatgcctggaaaaagtttaatatttgcagaaacacagatgcttcaagaaagtattcgtattcctggttccggtctgcatttaatgtatagaacaagcctcgcacctggttacctaagtaaagttgtcatgaggctcacacgctcaaagattcccaagtctcttgtgaaggttcatgttagggtggagattgaaggttcagtccacacaaaaacatatgaagcagaccctaatctaactcatgtatttgcttggaataagagaaacgtttataaacagaaagtctatggggtcgctcaagctaaaatatcaataggttacgagcactcaacttgccctagtattgtttgggaaacacagacagccacacttcaaggatttgatgtagatatctctgatgttggcggatggagtctcaatatacatcaccattacaactttcatgaaggtattttacaaaagggggatggatccacagttcatctgaagcaattggcccgtagtgtaaaagttgtgatgggtaccggattacagaggccactgcagtgcaaggattgtgatggtactgcaagagatgctaggcttttaactcctgttgcactgacttctggtcctgatggttcattatatgttggtgacttcaatctcattagacgtctcaccccagatggcaatgtttatactgtcttgcaactcagtgctacccaggtgtcatatcagtattatttagttttatctccagctgatggaagattatatgtgtcagatcctgaaagacacc

SEQ ID NO: 610 - DNA, 283 bp, Halyomorpha halys
agatcctgaaagacaccaaatcttacgagtaatatcattggattctgtaccagaaccatcaattaattgggaggttgcagttggttctggagaccgctgtatccctggggatgaaactagttgcggcgatgaaggtccagcgcttcaagctaaattggcacatcctaaaggattagcaatagctgctgataaaacaatgtatatagccgatggaactaacatcagatccgtagaccctaacggcattattcacaccctgattggacatcacaaacatcacaac

SEQ ID NO: 611 - DNA, 223 bp, Halyomorpha halys
catcacaaacatcacaacatatggcagcctataccatgcaaaggcgcaataccagcctctcaggcccagctacaatggcctactggtctcgctttaagtgcactagatggatctctccattttatcgatgaccgacttgtcttaaaacttacatctgatttaaaagtgcgccttgttgctggaactccacttcactgtcattctaatgctgaagaaaaacatg

SEQ ID NO: 612 - DNA, 350 bp, Halyomorpha halys
tgaagaaaaacatgaagaagagaagcaggttcagaccgaagaaggaacagtagctacttcaactgcgcttggcccagtactcgctcttgcatttagtcctgatgggttgctgtacatcgcagacacagactctcagaaagtaaatgctattagagttgtggatgcatcaggaaaaatggcttactttgctggaaaagttcaacaaaacaatgacaaaacgttatgtgattgtgccagcaacagtacttcaccgtgctcatgcttcagtgaaactagtaattcaaaggaaactctcttgtcaacaactgctagatttacttcaatatcagctgttgcagtgagcccagatg

SEQ ID NO: 613 - DNA, 3653 bp, Halyomorpha halys
ttgcagtgagcccagatgggatagttaatgttgctgaccagggtaatttgcatatcttagccctcgagcattatcttccaactcatgacgaaaatggggaattcagaataccttatccagctacagaggaaatttacgtttttaatcgttatggtcaacacatttcaacaagagatatcaccactggtaaacccaaatacacattcctctacagcaaaaatacaagttttggaaagttatcaacagttactgacagctctggaaataaaattcttttcttgagagactacagcaacgtagtgagtgcaatagaaaatactcaggatcataagtcggagctaaatatatctggtattggatttttgaccaagtttgttgagaaaggtcgttctgaaattgttcttgactacgatcctacatctgggctgctcacaagtagatcagactcctcagtatctggcggatcaacctatttatacaattacgactcactcggtcgattagttgatgcagttcttcccaccggtgaaacaatgtcattgacttcacaactaggtcaaaaagatgaacttgaagtttatatcactcttcctgttcatccaatgacaacagagctgcatcgtgtaggaatcagtctatcggtgatggctgaggctgggctgctacacaatagaactgttgtaatgagcaccagctctcagggtcgggtggagttgagacctggggctcgacaccctctactggaactggcaatgccagtgcaggctgagatgtggccaatgtggagtcggcagtctaccacaaggcatggtattaccaacagcatggctgctacttatactctggtcggagatgctgccaacaaccaacacactgttcatagtcatctttgggttaacagttccaaagtgctaggcattgagtatgatcaaggaaaaagcaggagaacagtttatgataaagaccaattacctattctcagtatcacttacaataaccatggcctacccacctcttggagacccgctaatactagaactttgaacattacatatgatagatttaatagaatcgaaggatggaaatggggaatgcaagcagaaacattttcttatgacaggcatggcttgctgtctgaggtcaagaccaaacaagatggtgttatcagatatacgtataatgacctaaacttagtcacccagataactctaggtagtggcaggaaagtatcattagtttatgacgagcatgctggattaagacatattgttttagcatcaggagcaaaacattctgtctcctgccagccctcgattggatttgtcagatttacatatactccacctggttcaactaagtcctacttgctccattatacacatgcagggaaattgcttcagatagtctaccctggagatggtgcacgtgttttgtatagatatcacccttcaggccaattagctgagatttttagtattgcaactaaaatgaagattcattacaggcttgactatggacccaaaactggattaagtaactctaaatttatgtaccaatatgatgacaacttcagactgatttctttacaaggcaggattggtggtcaaactttgccggaatattcaattcagtataatccaaaaacaggagcaaaaagccagatgggacagtttatggttacctggccatcaacaaatgagacctcattatctgattccacagcagtatttagtaggatttcaaataaacaatttcaagttatacaagtaactgtcactatccataggatggaagttttccgaatggaatacacttatgattctagaaatcgtataagccaaactcgaacttatacccgtaatgttggagtgaatacttacattaatgttaaaaatttgacttgggattctgacggtcagctgatagctgttgaggcacaagagccatggggcttcaaatatgatgctaacggaaatatgttatctctcacttacaggggaaatactattcctatggaatacaatgcaatggaccgtattgtaaaatttggtgatgggcaatatagatatgataatagaggcttagttgttcaaaatgcacgtgaagagaagtttcattacaacgctaaaggtttattggtacgagctactaaaaggggccgattcgatgtaaaatattactatgaccatcttgacaggttgtccacaagaaaagataattatggaaatgtaactcagtttttctacaccaatcataaaagaccagatgaggttacacatatctacagccctagggatggaaaacttatgtctttgacctatgatgatcggggacacctcattttcgctcaagtcttcagacacaaatactatgttgctactgaccaatgtggaaccccagtgatgatattcaaccaatatggtgaaggaattagagaaataatgaggtcaccttatggacatatagtttatgattcaaatccttatttatacttacctgttgacttttgcggaggcctgttagatcaggttacttccttagttcatatgcctggtggtaaagtctatgaccctctgataggtcagtggatgtcaccattgtggcaagaagtggttcaaaagctttcaaatcctacaaaattacatttgtataggtttaatggaaatgacccaattaatgtgcaccaaactcctcaccaactcggaggtacttctaaatcaataatgtttttaattcatgtaatttatgaaaattatgagagaagttggttatctcggttgggatatgatattgacagtttagtacctcagctggatcagggataccttcaactgcctggactccaaggatcaacttttgattctccattcacagtaacatctggttttctttcccacctatcagagagattcatgaaaaacaagctgtcatctctgccacagtcacaaataaggttgaacccgataaccgttgaagacagttcaaacaatgctgacttcaatccagtgagagctgcctttgggatcagtaagcaggctgggctcgggcttgaaccaggagctgaagcacagcctccctttggaaagggtattctagtgtcaaggactcatgagggacgtgctatcattcacagtgacccgaccgctaactctatctatagggatgttctcacatcagttttcaacaacacattccttctgccgttcacaatggtgttacatggtagtctacaggatgctttcttctttgttaaagaggatgcttggagagcacaagaggaccaagcacaattgaagcgatttggctcccagtttaacaccagctttattgaaaaggaaggagaaacagggtcagggaagatacaccgcccaaatgccattatcaatttaaggtatggtacaactattgagagggaaaagcaacgcttattgcaccatgcaaaggctgcagcactcagaaaactgtggcacaaagagagggatgcacttcgtaatgggctccctaccacacgtgaatgggctcaaggagaagtcgaagaactcctcaagtctggctttgtgagtggatttgatggagagcacattcgagatgcacagcgatacccagaacttgcagaggacccttataatataagatttgtgaaaaaatctcga

SEQ ID NO: 614 - DNA, 278 bp, Halyomorpha halys
acaaatggttgtagatgtaactcatcctggccttccttcagttaagaaaactgaaatcagggaaaaactggcaaagatgtacaagtgtacccctgatgttgtcttttgtttcggtttccacactaattttggtggtggcaaatcatctgggttcgcattgatctatgaaacacttgatttcgccaagaaatttgaacctaaacataggcttgctaggcatggcctatatgagaagaaacagcaaacccgaaagcagaggaaggaacgcaagaacagaa

SEQ ID NO: 615 - DNA, 816 bp, Halyomorpha halys
atgtcatgtaagtcatttctttctttcttttgccaggacctggagttccatggggtgatgcggttctactttcaggactcgggtcagaaagtggccaccaagtgcatccgggtcgcctcggacgccaccgcccaggttgtcatagagacgctcatcgagaaattccgtccagacatgcgaatgttgtccatcccggagtatgctctctatgaaatccacgaaaatggggaagaaaggcggttggagcccgatgaaaagcctctcctggttcaacttaattggcacaaagatgacagagaaggaagattcttgctcagaaggatcgatgacaaaaccaatatgccagaaggcactttccaggaaggtggctcaagttttagaagaaagttatcaaaaagagaaaagaaacaattaaagaagcaagagaaattaaatagaatgaagagtgctggattaacaaatgatgaaaatgattctggagtggcagaaaagttatatacagaattgccggagacaagcttcacccggtcgatatccaaccctgaagctgtgatgaggagaagaagacagcaaaaacttgagcgaaaattacagcagttccgaagcaaagacggagggccagataccggtggtaccctcaagatttatggagaagccctttgcagagatgtcccctacaagacactcctcttatcgatcggggacacagctgcacaagttgtcaaagaaatgttaatgaagtacgggctggacaaagaagaacctcaacactactgcctcgttcaagtaattattctgtatagtttattttgtatt

SEQ ID NO: 616 - DNA, 418 bp, Halyomorpha halys
atggtggtgctagagaattcccccaacgctaagatgaataaaactgttctcaaccgcttcttggcattgccccagcctgacaacaaagtccaggcaatgtatgtctggatagacggaacaggagaaggtctcagggcaaagacgaggactttagactttgtgccaacttctgttgatcaattaccaatctggaattatgacggaagttctacgatgcaatcagaaggtgtcaactctgatacatatctttacccagtcgcaatgtacaaggatcccttcagacttggcaacaataagctaattttgtgtgatacctacaagtataataagaaacccacagaaacaaatcaccgctacagctgcttggatgcaatgacaaaggcagcagatcaaaaaccctggttcggaattgaacaag

SEQ ID NO: 617 - DNA, 602 bp, Halyomorpha halys
gcggcgttggtgccaacaaagtctacggacgtgacatagtcgaggcgcattacagagcatgtttatatgctggaatcaacattgcaggaagtaatgcagaagtcatgccttctcagtgggagttccaagttggaccttgcgaaggaattgccattgcagatcagttgtggatggcccgtttccttctgcaccgtgttgctgaagaatttggagtttgcgtgacacttgatcccaaaccaatgccaggagactggaatggtgctggtgcccattgcaacttctccaccaaagatatgagagaaaataacggaatcattcatatcgaaaacgcaattgacaaattgtctaaacagcacctgagacacattaaagcttatgatcctaatgaaggcagagataatgagaggagattgactgggcgccatgaaacatcttccattcatgacttcagtgcaggagttgcaaaccgaggtgctagtataaggattccaagacagtgcgctgaagacaagaaagggtacctagaagacagaagaccagcatccaattgcgatccttacagcgtaactgaggctcttatgcgcacagtctgccttaacgaa

SEQ ID NO: 618 - DNA, 206 bp, Halyomorpha halys
gttactgtaaaggagcagaaagagtggaaaatccctccttgtatttcaaattggaaaaacgctaaggggtatacaatacctttagataaaaggcttgctgcagatggaagaggactgcaacaagttcacattaatgaaaactttgccaaacttgctgaagctttgtatatagctgataggaaggcacgagaagctgttgaaatgag

SEQ ID NO: 619 - DNA, 668 bp, Halyomorpha halys
ctcagaaagaaaaggaaaagaaagaagagcatttgcgacaacttgctcagaaagctagggaagaaagagctgggatcagaactcttgcaaaccatgaaaaagatgaagaagccagagaaagagatcagctaaggtttgaaaggcataaggaccgagctagagaacgaaatttggctagagctgctccagacaaaaggtctaaacttgtaaaggaaagggaaagagatatcagcgagcaaattgctctcggattacctgctaaaacacagcttgttggcgaagctgcatttgatcaacggttattcaatacaactaaaggaatggattctggttttggtgacgatgaatcatataatgtctatgacaaagcttggcgagagtcaaatactctttctcaacatttataccgacctacgaagaatgttgataaagatatgtatggtgatgaccttgataaaatcatcaaaactaatagatttgtacctgacaaagaatttagtggaactgatcgtggtgggtcaagtcgtgttggaccagttcagttttacaaagaagaagatgatccatttggtttggatcagttcttgacacaagctaagaaagctcaaggatcttcaaagcgaactgccaaggatgatcgaagggaggataaaaggcgaagaaaagat

SEQ ID NO: 620 - DNA, 385 bp, Halyomorpha halys
atgatatcgagatattacgatatgtcttacatcgaccaatactcgctacaagcagatgtttttaagttagataagcaaggctaccacttaggcggttgggctgaaacacctagaactgatagaactggaggtgctgacctgattcaagacactcctacccctagcgccagtaaaagaaggtctcgatgggacgaaactccgtcagctacccctgcgggtggtatgacaccccaaacaccagccgcagtcactacaccactgattgctccgagcgtgacaccgaccggccagaaggccatggcaatggccactcccacaccagggcacttgatgacgatgacacctgagcaactgcaagcctatagatgggaaagagaaattgatg

SEQ ID NO: 621 - DNA, 601 bp, Halyomorpha halys
aaagagaaattgatgagaggaacaggccgttgacagacgatgagttggaatctatgttccccccaggctacaagattctcaaccctcctgctggctacattccgataagaacacctggtagaaaactaactgcaacacctacaccgattgctggcacgccacagggatttttcattcagcaagaagacaaaggtgctaaatttgttgacaaccagccaaaaggaaatctgcctttcttgaaaccagaagacgctcaatacttcgacaagctgcttgttgacgttgacgaggagacactttctcccgaggagcagaaagagcgcaaaatcatgagacttctgctgaagatcaagaacggaacaccaccgatgaggaaggctgctttgagacaaatcaccgacaaagcgagagaattcggagcgggtcccttgttcaatcaaatcttgcctttgcttatgtctcctacgcttgaagatcaggaacgtcacttgttagtcaaagtcatcgacaggattttgtataaacttgatgatttagttcgtccttatgttcacaagatccttgtcgttattgaaccgttgctgattgatgaagattacta

SEQ ID NO: 622 - DNA, 559 bp, Halyomorpha halys
atgcattttcaacaagaatgttatatagaagaggactacatgaggggtgacagaggttcgaacgaggtgagctgtcacgacgggggcattcctatcttcaggctgcggagcgtcgaggagacagaggcggcccacgacctcctggagctgagccgctcgctgccaccactacctgcccccggtgtcaccccgcactactcactgccccaggagcccctctacactcacagcgcccagccggtctaccactgctgcgaggaggtccaacatcccaccagccaacccccactcacacctccaaactcagagtattcttccgatgccgagaacaataaccccaaccaggcccctagttctggacccaacctccagcctgccgtctatacctacgatgcccttctagtcactgacggcaggtccaagaaccgaaaagagcggaagacgacgggaaaagtggctccactcagtcccatctcttcagacgacggtgtgacgaccgaagcagaagaaaacccctgtgacaaaggtggacgttacgtctgctctgagtgtggtaaga

SEQ ID NO: 623 - DNA, 222 bp, Halyomorpha halys
gctctgagtgtggtaagaagtacgcgacctcctcaaacctgtcgaggcacaaacagacccacagaagcctggactcccagtcggctaagaaatgtgtgacctgtggcaaggcttacgtgagtatgccggccctcgcaatgcacctactgacgcacaagctatcacacgcttgcggagtctgcgggaagctgttctcgaggccttggctactccagggacacc

SEQ ID NO: 624 - DNA, 242 bp, Halyomorpha halys
ctggagagaagccctacggatgcgctcactgcgggaaggccttcgcagaccggtccaacctgagggcacacatgcaaacccactcggctgacaagaactaccagtgcaacaggtgccataagaccttcgccctcaagtcctacctcaacaagcatctcgagtcagcctgcatcaaagaggaacaagaaggagtcgatgtcactgtagtgttcgaaaatgtccggtcgagtttgcaggttcag

SEQ ID NO: 625 - DNA, 593 bp, Halyomorpha halys
atggctaggtatagccaacgtcctgaaaatgctcttaagagagccaatgagttcattgatgtggggaaaccagctagagctttagatacactttatgaagtatttaggaacaaaaaatgggcctacaattggagcgaaagtttgctggaacccattatgttcaagtatttagacctttgcgtggaactaaaaaaatcattaatagcaaaagaaggtttattccagtaccgaaatatgtttcaatctgtaaatgttggctccttagaaaatgtaatccgaggatacctccgaatggctgaagaaaaaactgaatctgccagagaacaatctcaacaagctgttattgatattgatgatttagacaatcttgctactccagagagcatattgttgagtgctgtcagcggtgaagatgctcaggatagaagtgacaggacaatccttactccttgggtcaaatttttatgggaatcatattgccagtgtttggaactgctccgaacaaatgctcattgcgaaacactgtaccatgacatcgctcggatggcctttaatttctgtttgaaatataatagaaaaacagaatttagaaa

SEQ ID NO: 626 - DNA, 388 bp, Halyomorpha halys
aaaaacagaatttagaaaattatgtgataaattaaggaagcatttagaagatataagtaaattgccagttcaggtggcaaacgtaagccttaataagcctgaaacgcagcagtataatttggaaactagattagttcagcttgattctgctatacagatggaactgtggcaggaagcttataaagcaatagaagatatacatggattaatgaacatgtctaaaaaaccaccagtgactaaaactatggcaaattattatcaaaaattagctatggtcttctggaaagctggttactaccttttccatgctgctgctcttttcaaacttttccagctttctaaagatatgaagaaaaacataacatccgatgagcttcaaaggtctgat

SEQ ID NO: 627 - DNA, 216 bp, Halyomorpha halys
agcaggagcagaagcagcgaagcaggatctacaggtgggggatttttgtttgacttggggcaatgtgattgcagcagggggtccgtttcgacccggatatgccgcagacgatcaggctggagttcgcgaaaagcaacaccaaggtcagcaagcccaagcagccctcagcaagtctcaccaactcacacccgactctcatgcacccactcactggac

SEQ ID NO: 628 - DNA, 465 bp, Halyomorpha halys
gcacccactcactggacatatttatgcataactgttgcagacttgggtgggcctttcttcaccggtggacctgagctatggcctcaccccctagcttatgctgcagaactaccaggaactgctcttcaacacgccacactggtccatccagcccttcacccccaggtcccacaggcactccagatgggaggtgcagcgccaccattgacacactcactccctcactttctaccatctccagcactagcctctccagttgcatcttctccaactccagccggcacgattcccaataatgggccatgctctacattgtttgtcgcaaatcttggccagtttgtttccgagcatgaactaaaggaaatatttagcagtgatactgacgagatttacaatatttttgttcccaaggaaaagtctgagtctgaagtcagttatgaatcgagtgacgatgatgaggaggac

SEQ ID NO: 629 - DNA, 1128 bp, Halyomorpha halys
atggaaccttatgaagttattgttaatcaaccagttgtcattgataatggatctggagtcataaaagctggatttgctggggatcaaataccaaaatgttgttttccaaattatattgggcgaccaaaacacatacgtgttatggctggggcgttagaaggagacttgtttgttggacctaaagcagaagaacacagaggattattaagtttgaagtatccaatggaacatgggattgttactgattggaatgacatggaaaggatatggcagtatgtatatggaaatgatcagctacaaacatttgccgaagagcatcccgtgttgctcacagaggccccgctcaatcctaagaggaatagggaaaaggctgcagaaatattttttgaatccttcaatgttcctgctctatatgtttcaatgcaatctgttttaagtttatatgcaactggtaggactactggtgtggttcttgactcaggtgatggtgtcactcatgctgttccaatatatgaaggatttgctatgccacatagtataatgaggactgatattgctggaagagatgtttcgcgatatttaagacttcttctgcggaaagaaggggtttacttaaaaacaactgccgaatttgaaatagttcgaaccataaaagaaaaagcatgttacttatcaagtaatccacaaaaagaggattcggctgacacggaaaaacaacaatatctacttcccgacgggagttctctagatattggaggtgcaaggtatcgtgctccagaagtgttgttcaggccagatttgatcggtgaagagtgcgaaggtatacacgaagttctagtctattccatacagaaatcagatctcgatttaaggagggttctctttcagaatattgttttatctggtggttctacattattcaagggttttggagacagattactttctgagattaaaaaagtagcacctaaggatattaaaatcagaatatctgctccacaagaacgactatattctacttggattggtggatccatcttggcatctttagatactttcaagagaatgtgggtctcaaagcgtgaatttgaggatgaaggcgggagagcgattcacaggaaaacattc

SEQ ID NO: 630 - DNA, 302 bp, Halyomorpha halys
cagcgtctgcagagttctcctgtcacactcctgcttctgcagaaatggaaaattgtactgtaaacctgattacgagaggttgttcggagtgaagtgcagtaggtgtggagatcggttacttccccacgaaatggttatgagagcccagagccatgtcttccacctttcttgctttagctgtgtcatttgtctacagactttacagaaaggagaacaattcgttgttcggagcggtcagatcttctgccgacaagactacgaaaaagagatgtttttattacagcagtccacatctccatcag

SEQ ID NO: 631 - DNA, 382 bp, Halyomorpha halys
agtccacatctccatcagatgaaatgattctcgatgagaacagtcggccgagagatggaagaagagggccaaaaaggccaaggaccatattaacatcggctcagcgcagacagtttaaagcttccttcgaagtcagcccaaaaccctgtcgaaaggtaagagaggctctagcaaaggagacgggtttgagtgtgagagtagttcaagtttggttccaaaaccaacgggccaaaatgaagaagattcaacggaaagcaaagcaggactctgataaatcgccgactgacaaagatgataaacgagaaaaatgtataaagcaggaacctctgtctaatgaacacaaaaactgctcgttgattccgactattaaacaattactaga

SEQ ID NO: 632 - DNA, 217 bp, Halyomorpha halys
tattaaacaattactagacaaatggtctaaacttccaactaattacaaaatattcatttatatgatcataataaaacctagttggactaacttaattaagctttggggctccactaaacaatcaaattcttctcctttccaatccttaatgatccttggttacaaatcaagtcatccatcagaacctcaatgttctatatgttgccggattgggcca

SEQ ID NO: 633 - DNA, 262 bp, Halyomorpha halys
atgtttctcacacgttcagagtatgacaggggagtgaatactttctcgcccgaggggagattgtttcaggtggagtatgccatagaagctattaagttaggttccactgcaataggtgtctgcaccccagaaggagttgttatgggggctgaaaagagaattaagtccccattaatggaaccagaagctgttgagaagattcttcaagtggatgatcatattggttgtgcagtaagtggtttgatggctgattccagaacct

SEQ ID NO: 634 - DNA, 258 bp, Halyomorpha halys
tggctgattccagaaccttagttgagcatgctagagttcagtgccttaatcattggtttgtttatgatgagaagatgccaattgagtcagctgctcaagcagtctcaaatttagccatcagattcggcgatgcagatgaggatgctggcccagcaatgagtaggccctttggggttgctgttatgttcggaggatatgattatagaggacctcagctctatcacatggatccatctggcacatttatttattttgatg

SEQ ID NO: 635 - DNA, 263 bp, Halyomorpha halys
catttatttattttgatgctaaagctataggctctggaagcgaaggagcacaacagagacttcaagaattatatcataaaggaatgagcctcaaagaggctatgcagatgattttaactattttaaaagaagtaatggaagaaaaattgactgataacaatgtagaaatagcagtcgtaactgcagaagagaaacagtttcgtatgtacaccaaggaagaagtttctaaagtaataggagaaacacaattggcacaaacttcg

SEQ ID NO: 636 - DNA, 280 bp, Halyomorpha halys
atgacgacttatgaggaattcattcaacaaagtgaagatagggatggtattagatttacttggaatgtttggccatctagtcgcctagaagccacaaaacttgtggttcctgttggatgccttttccagcctttgagagagcgagttgatttacctccaattcaatatgatcctgtccagtgcaccagaaatacatgcagagcaattctaaaccctctttgccaggttgactaccgagctaaactctgggtatgtaatttttgctttcaaagaaatcctt

SEQ ID NO: 637 - DNA, 1719 bp, Halyomorpha halys
gctttcaaagaaatcctttcccacctcaatatgctggtatatcagaacaacaccagccagccgagcttattccttctttttcgacaatagaatatacaataacaagggctcagtttctgcctcctatttttcttctagttgttgatacatgtttagatgatgaagaacttggagctttgaaagattctttgcagacttctttgtctttacttcctccgaatgctttgattgggttaataacatttggaagaatggttcaagttcatgagttgtcaacagaaggttgttctaggagcttcgtattcaggggtactaaagaattatcggctaaacaagttcaagatatgttaggtattggaaaagtcccaagtgctgcaacattcaatcctgccgttcctggacaacctccaggccagcagccattgcctgctaatcgttttattcaaccagttcaatcttgtgatatgagccttacagatcttctcggagaaatgcaacgggacccctggcctgtaagtactggaaaaagacctttaagatcgactggtgcagcgttggccattgctgttggtttgctggaatgttcataccctaatactggtgctagaataatgctttttgttggaggaccatgctcacaagggcctggtcttgttgttaatgatgatcttagggaacctattcggtcacatcatgatattcacaaagataatgctagatacatgaagaaagctatcaaacattatgaaagtttagcaatcagagctgctactaatggacatagtattgatatatattcttgtgctttagatcagactgggctccatgaaatgaaatcgtgctgcaactctactggtgggcatatggtaatgggagattcgttcaattcttccttgttcaaacaatctttccaaagagtactctctcgtgatcaggttggtgattttaaaatggcatttaatggggttctagaagtgaaagcttctcgagagcttaaagttatgggtgctatcgggtcttgtgtatcattgaatgtcaaagggccttgtgttagtgatagtgatattggtttgggcggaacatctcaatggaaattctgctctctaactcctagcatgacctgtgcatttttctttgaagtgatcaatcaacatggtgcaccaattcctcaaggtggcaggggatgtattcaatttattactcagtatcagcatgctaccggacaaaggcgaatcagagtaaccacaatcgctagaaactgggccgatgctactaccaacctccatcatataagtgctggatttgaccaggaagctgctgctgtcttaatggcaagaatggttgtacaccgtgccgagtctgatgatggaccagatgtgatgcgttgggctgatagaatgctaattagactctgccagaaatttggtgaatacaataaagatgaccctaacagtttccgtctaccagaaaacttttcactttatccgcagttcatgtatcacctgagaagatcacaatttttacaagttttcaataatagccctgatgagacatcttattacaggcatattttgatgagagaagatctatctcaaagtcttatcatgatccagcctatattatatagttacagttttaatggaccgccagagccagtgctcttggatacttctagtatccaaccagatagaatccttcttatggacacattcttccaga

SEQ ID NO: 638 - DNA, 346 bp, Halyomorpha halys
ggacacattcttccagattctgatattccatggagagacgatagcacagtggagagcccagaggtatcaagacatgccagaatatgaaaacttcaaacaacttttacaagctcctgtagatgatgccaaggacattttacatacaagatttccgatgccaaggtatatcgatactgaacagggaggatctcaggctaggttcctcctttcgaaagtaaacccttcgcaaacccataacaacatgtatgcatatggtggtgaatctggagcacctgtgctcacagatgatgtaagtcttcagactttcatggatcatttgaaaaaattagctgtatcttcaacagct

SEQ ID NO: 639 - DNA, 301 bp, Halyomorpha halys
atgaattcattatacaatatccaaggaggagtggtgggtaggagaggggggttcagaggaccaatgggaagaggaggcgtggccgtggaggggcgggacgaagcagtagcacagtcagtcaggatgtctctcccgtcgggtgtcgacatgtcagctctaatgtcccagcacgccgtctttccgccagccttcttcttacgggccagcgaacgctaccagaggacgcccaagtgcgccaggtgcagaaaccacggagtcgtaagcgctctcaaaggtcacaagcgctactgccgctggcggg

SEQ ID NO: 640 - DNA, 215 bp, Halyomorpha halys
gggtgatggccgcccaggttgctcttcgccggcagcaggcccaggaagagagcgaagcgagggaactcggcctggtctacaccagtgagccgcctctcttacctcctccaacccttccaggtcagtgtcttcctataaaggaatattcatatatattactcacttcttatcaatctaaaattctcttgaatgacacagttgtcaaatggcttgag

SEQ ID NO: 641 - DNA, 217 bp, Halyomorpha halys
atcctgtttgctgacattgtcggatttactgtcctagcttctcagtgcactgcacaggagctagttcggctcttgaatgaattgtttggaaggtttgatcaattagccaatgataaccactgcctgaggataaaaattctcggtgattgctattattgtgtctcaggtctgccagatccaagatcagaccatgcaaaatgctgtgttgaaatgggtc

SEQ ID NO: 642 - DNA, 208 bp, Halyomorpha halys
atgttctgtttgttaaaaacatttctattatttcaaagatgcttgataaaagtccttaacattaaactctggaaattgtacttagcgtatgtgaaagaaacgaaagcagctttaccaacttttaaagaaaagatggctcaagcttacgatttcgctctagagaaaataggtatggatattcaatcctatagtatatggaatgattatg

SEQ ID NO: 643 - DNA, 536 bp, Halyomorpha halys
gtatatggaatgattatgttactttcctgaaaggagttgaagcagttggttcatatgcggaaaatcaaaaaatcacagcagttcgaaaggtctaccagaggggagtggtgaatccaatgctgaaaatagaaaacctttggaaagactacatggcctatgagcaaggaatcaacccaattattgcggagaaaatggctatggagaggagtagggactacatgaatgctcggagggtagcgaaggaatttgaagccatcacaagaggtttaagtcgtagcattccttcagttcctccaactggcagtttagaagaattaaaacaggttgaactttggaaaaaatatattgcttgggagaagagtaatcctttgaggagtgaagataccgctctcgttactagaagggtcatgttcgcttttgaacaatgtttactttgtcttggtcatcacgctgatatatggtatgaagcagctcaatttctcgattacagttcgaaagttctaactgagaaaggtgtaagtaatcttgtatatgtt

SEQ ID NO: 644 - DNA, 214 bp, Halyomorpha halys
atgggccaggacataacttacccaacatatgatacagtgccaaagggtttggccttttcttgccagtcgaggcctcctggttactacgcagaccctgaagctcagtgccaagtgtggcattggtgcttgccaaccggtgctatgtactccttcctatgccccaacggtacggtgttcaaccaggccgtacgggtctgcgattggtggttcaacg

SEQ ID NO: 645 - DNA, 420 bp, Halyomorpha halys
atgcacactccattgtatgaggtttgtgaacattgcacccaccgaaatgctaaggaatataattggcaaaacaagactatcattttagcagcagattatgcctccaacggtatttacaacttcattatccccctgcgggctcactttagaatttatttctttttcaggtccaaaaattctctcaatcccattattcttctattggaaagacgcccagacattgcatttttagattcagtatcatactttccgttaatttactggatgttgggatcaatagattgcttagacgatttgttgcgcgctgggattacattagctgaaaatgttgtagttgtcaacaaagaactgtcaaactcagctgaagaagacacactagcagattgtaacactatcgttgcagtacaaactatgttcaag

SEQ ID NO: 646 - DNA, 334 bp, Halyomorpha halys
atgtaccacacggagcgacttttccagcaactgtgtgtcgagagcacggagtacggagttctgtcagtgcgggcatattttcaccacgactccctctgcgtcgaagtactcaatgctagagatgtcatacccctggatcctaacggattcagcgatcccttcgttatcgtcgaacttctgcctaaagcagtcttcccgcactgctcagagcaagtgaccaacgtccagaagaaaacattgaacccgttctttgacgagtgttttgaattctcggtcaccctggagcagtgtaaatccgagagcgctatgatcgccttcaccgtcatggaccacg

SEQ ID NO: 647 - DNA, 635 bp, Halyomorpha halys
atgagcaacgatttctccgacattgatgctgaaatattacatatgtccaatgaagaaatatataacaggataagacttctagatggagaagtaaggattatgaagagtgaagtaatgcgggtatctcatgaattgcaatcgcagaaagagaagattaaagaaaataatgaaaagataaaggtgaataaacacttaccttatctggtttcaaatgtcatagaaatattagatatggaagcagaaaatgaagatgaaggggcagttgtagatttgcatgcaaaaagtagtggaaaatctgcagttataaaaacatctaccaggcaaacttattttttacctatgataggacttgttgaaccaacaatgctcaagccaggccaattaattggtgtaaataaagattcctatttgattttagaaaaactaccatcagaatatgatgcaagggttaaagctatggaagttgatgaaagacccactgaccaatattcagatatagggggcttagataagcaaatagaagaattgatggaagctgtggtacttccgttattacacaaagaaaaatttgaagcaataggtgtgaagcccccaaaaggcgtactactttatggtcctcctggaactggaaaaac

SEQ ID NO: 648 - DNA, 276 bp, Halyomorpha halys
tcctggaactggaaaaactctgcttgcaagagcatgtgcatcacaaactaaatcaacatttttaaagttggctggacctcagttagttcagatgtttattggagatggttcaaagttagtcagagacgcatttgctcttgccaaagaaaaaacccctgctataatttttattgatgaagtagatgcaataggcacaaaaagatttgattcaacaatagctggagacagggaagttcagagaacaatgatagaattactcaatcagcttgatggttt

SEQ ID NO: 649 - DNA, 357 bp, Halyomorpha halys
caatcagcttgatggttttagttctactgatgatataaaagttatagctgcgaccaatagagttgatatactagatcctgctcttttaagatctggcagactcgataaaaaaattgaatttcctcatccaaatgaagacgctcgtgcaagaataatgcaaatacattctcgaaaaatggtgacaagtccagatgtgaattttgaagaacttgcccgatcaacagatgacttcaatggagcacagtgtaaggctgtttgtgttgaagctggtatgatggcccttaaaaggaataaaccaatggtagatcatgaagatttcatggatgctatatttgaagtacaagccaagaagaaagc

SEQ ID NO: 650 - DNA, 292 bp, Halyomorpha halys
atggctgttggtaaaaataagggtctttcgaagggaggaaagaagggagttaaaaagaaggtagttgaccctttcacaaggaaagattggtatgatgtcaaggccccttctatgttcaatacccggcaaatcgggaagactcttgttaacagaacccaaggaactaaaattgcttccgaaggactcaaaggtcgagtttttgaagtaagcttagctgatcttcagaacgatactgatgctgaaagatcattcaggaaattccgcctcatcgccgaagatgttcaaggcagaa

SEQ ID NO: 651 - DNA, 512 bp, Halyomorpha halys
aagatgttcaaggcagaaatgttttgaccaattttcatggtatggatttgaccacagacaaactgaggagcatggtgaaaaagtggcagactctgattgaagccaatgtggatgtacgcacaactgacggctatctattacgagtgttttgcattggttttaccaataaggaccagatgtcccagcgtaaaacttgttatgcccaacataatcaagtcagagccattaggaaaaagatggtcgataacataactaataacattagcaacagcgatttaaggattgtcgtaaacaaactgatcccagattcaatagcaaaagacatagaaaaaatatgtcaaggcatctatcccctccatgatgtctacattaggaaggttaaagtactgaagaaaccaaggttcgagttaagcaaacttctcgaacttcatggagatgggaaaggttctgatgaacctggctcaaaagtttcgaggcctgaggcttatgagcctccagttcaggagtcagtt

SEQ ID NO: 652 - DNA, 214 bp, Halyomorpha halys
atgtgtattcaaaagttgccggaggcgagacgtttccatagcaacggagggtgtcacgtgattggacaagttatattcccgcctagaggaggttatacatggtgggcccaattgttgatacgcgcttgctacactaaaatgcagtggcttattactagctatggagcggtaatacgcttgggcatggaagcgatggcccccctcggggagcagg

SEQ ID NO: 653 - DNA, 1119 bp, Halyomorpha halys
cccctcggggagcaggagctgttcaacatgaacgggttggtgcccgtgaacgggctcggccttctccacatgaacggcggccagttgccgcttctcaagccatcggagcagctgaagcaagtcaacggaggaggatccgcgcccgctccgccgccgcctgctgttcaacaggagccatcccccgccggcggttcgcagccccccgctgcctcctcttcaggcaggtccacccccaactctagcgatccctccgccgctaagctcttcgttggcggtcttagctggcaaaccagcagtgagaaattgaggcagtatttcggcatgttcggcactgtcaccgacgttctcatcatgaaagaccccatcactcaaagaagcagaggttttggattcatcacatttgctgaagcagacacagtagaaaaagtcctcaaggttccaattcacaccctcgatggaaagaaaatcgatcccaaacatgcaacaccgaaaaatagacctaaagccaccaacaagactaagaaaatattcgttggcggagtaagtcaagacacgtcatcagacgaagtaaaagcttacttctctcagttcggtaaagtggaagagactgtaatgttgatggatcaacaaacgaaaaggcataggggttttggatttgtgacattcgagagtgaggacgttgtagataggatttgtgaaattcatttccatacaattaagaataaaaaggtagaatgtaagaaggcccagcccaaagaggcagtagcagcagccggtctgttactgggtaagagagtgatgatgggtccccttggtgtccggatggcggccccagccccagtccctacaggcccgctggttagtgtcacagcagctgcagttgctgctcagcaggctgtggcaggctatagcaagctgtttggtggctatcctggtctggcttcttatcgctatgccccttatccagtagcagcccctgctacacctacacctgcagctcctgctccccccaccctcactccagcctcgccgtatcagggctacacccttcccaatgtggatatgtctagtttccagggggttgattggggttccatgtacggtatgggcatgtacgtc

SEQ ID NO: 654 - DNA, 332 bp, Halyomorpha halys
tgctggtgcctacgatcagttaaagcagaatgctaccaaggcgaggattccattttatggaagttacacagaaattgacccggttgttattgctcaagatggtgtggatatgtttaaaaaggaagggtttgaaataataattgttgataccagcggtcgacacaagcaggaagaatctctttttgaagagatgttacaagtttctaatgctatcaaacctgataatattatattcgttatggatgcaacaattggtcaagcttgtgaagcacaggctaaagccttcaaggaaaaggttgatgtaggagctgtaatcataaccaagttggatg

SEQ ID NO: 655 - DNA, 517 bp, Halyomorpha halys
tcataaccaagttggatgggcatgcaaagggtggtggtgcccttagtgcggttgcagctacaaatagtcccattatatttattggtactggtgaacacattgatgacctcgaaccattcaaaacgaaaccatttattagtaaacttttgggaatgggtgatattgaaggcctcattgataaagtgaatgagctgaaacttgatgataatgaagaactaattgaaaaaatcaaacatggacagtttactatgcgggatatgtacgagcagttccaaaacattatgaaaatgggaccattctctcagattatgggaatgattcctggttttagtcaggatttcttatctaaaggcagtgagcaagaatcaatggcccgtctcaaaaaactcatgacaattatggacagtatgaatgacggagaactggataataaagatggagctaaattgttttccaagcagcctggcagagttataagagtggctcagggttccggggttacagaaaaagaggttaa

SEQ ID NO: 656 - DNA, 266 bp, Halyomorpha halys
ttactgaagaaaaatttattgtcaaggccacaaatggcccaagatatgttgttggttgtaggcgacaacttgataagttaaaacttaaatctggaactagggtagcattggacatgacaacattgacaattatgagacacttaccgagggaagttgatccattagtatacaatatgtctcatgaagacccaggagatgtcacatattctgctattggaggtcttgcagaacaaattagggaacttcgtgaggtaaacatgatttat

SEQ ID NO: 657 - DNA, 921 bp, Halyomorpha halys
attgtggttttgagcatccttctgaagttcaacatgagtgcatacctcaagcagttcttggtatggatatactttgccaagctaaatctggaatgggtaaaactgctgtgtttgtattagccacccttcaacaaatggagttgactgaaaatcaagtgacagttttggtcatgtgccataccagagaattggcatttcaaattagcaaagaatatgaacgtttttcaaaatatatgccaaacattaaggtcgctgtgttttttggtggtttacctattcagaaggatgaagaagttttaaaaaataactgtcctcacatcgtagttggtacaccaggacgtattttagctttagtgaagaataaaaaacttaatttgaaaaacctgaaacattttgtgttagatgagtgtgacaaaatgcttgagcagttagacatgagacgtgatgttcaagaaatttttagaaatacacctcatagtaagcaagttatgatgtttagtgctactctcagtaaggatattaggccagtctgtaagaaatttatgcaagatcccatggaagtttatgtagatgatgaagctaagctaaccctacatgggcttcagcagcactatgttaaactcaaagaaaatgaaaaaaataaaaaattatttgatttacttgacatcttagagtttaatcaggttgtaatatttgtaaaatcagttcagagatgtatggctttggctcaactgttatgtgatcagaatttccctgctgtagctatacatagagctatgagtcaagaagagagacttgctaagtaccaggaattcaaagactttcaaaagaggattcttgttgctaccaatttgtttggaagaggaatggatattgaaagagtaaacattgtatttaattatgatatgccagaagattcag

SEQ ID NO: 658 - DNA, 206 bp, Halyomorpha halys
atatgccagaagattcagatacttatctccatagagtagcaagagcaggacgtttcggaactaaggggttggcaattacatttgctagtgacgaggcagatgctaaagttctgaataatgttcaggacagatttgatgttaatattactgagttacctgatgagattgacctttcgtcttatagtaagtattacgtattcattttt

SEQ ID NO: 659 - DNA, 204 bp, Halyomorpha halys
agactcagcagatcctttctattggattcgtgtgatacttgcctcaaacagaggtactctcatggaacttggaatatccccgattgttacatcaggcctcattatgcaattgcttgctggagcaaagataattgaagtcggtgatacgcccaaagacagggctcttttcaatggagctcagaaactatttggaatggttattac

SEQ ID NO: 660 - DNA, 427 bp, Halyomorpha halys
gaatggttattactgttggacaagcaattgtatatgttatgactggaatgtatggagacccagctgaaattggagcgggtatttgtttgcttatcatcgttcagctgtttgttgctggtcttatagttcttttacttgacgaacttctgcagaagggctatggtcttgggtcaggaatctctctgttcattgctacaaatatctgtgaaactattgtttggaaggcattttccccagctactgttaacactggtaggggaactgagtttgaaggtgctgtcattgcacttttccatcttctcgcgacaaggcaagacaaagtccgtgcattgcgtgaagctttctatagacaaaaccttcccaatttaatgaacttacttgctaccatccttgtgttcgccatagttatttatttccagggattcag

SEQ ID NO: 661 - DNA, 221 bp, Halyomorpha halys
ttatttccagggattcagagtagatcttccaatcaaatcagctcgttatcgaggccaatatagcagctatcctattaaactcttctatacttcgaatattcctattattcttcaatcagctcttgtatcaaatctgtatgtgatatctcagatgcttgctgtgaaattccatggaaatgtgtttgttaacatgttaggagtatgggctgatgttggaggcg

SEQ ID NO: 662 - DNA, 207 bp, Halyomorpha halys
gggctgatgttggaggcggtggtccggccagagcttatccagtcggcggtctttgttattatctctcgcctcctgaaaatcttggtcatatacttgaagatcccattcatgctatgctgtacatcatctttatgcttggttcttgtgctttcttttctaagacttggattgaggtttctggttcatcagccaaagatgttgcaaagc

SEQ ID NO: 663 - DNA, 207 bp, Halyomorpha halys
aagatgttgcaaagcagcttaaggaacaacaaatggtaatgcgaggccatcgtgacaattccatgattcacgaactgaataggtacatccctactgcagcagcctttggaggtctttgcattggtgcactgtcagtcttagccgactttatgggagcaatcggctcaggaactggtatccttcttgctgttaccatcatttaccagt

SEQ ID NO: 664 - DNA, 403 bp, Halyomorpha halys
atggctgaacaagaagaagtacagaagaagaagagggcgttcaggaagtttacttttaggggtgttgatctcgatcaacttcttgacatgcctatggagcaacttaccaagcttatgcactgccgtgcaaggaggaggatttccgtcagagggctcaagaggaagcccaatgcattaattaagaagctgcgaaaggttaaaaagcttgcacctccaaatgaaaaaccagaggttgtgaaaacccatcttagaaatatgatcatcttaccagagatggttggaagcattgttggtgtctacaatggaaaggcattcaatcaagttgaaattaagcccgagatgattggtcactatcttggcgaattcagcttgacctacaagcctgtcaagcacggtcgtcctg

SEQ ID NO: 665 - DNA, 357 bp, Halyomorpha halys
aaagaaaaacaggtggaacttcagaaaaaaatgaatccttctattcttgggaacgatgcaagtcaatcttcaaatatgttgaatcaagcacgtctcaaagctttgaaaatacgtgaagatcatgttcgtgatgtgcttgatgatgccaggaagagactattgcaatcagtcaaagatgaggcacgttacagagatattcttgtgaaacttatgcttcaggggttatatcagttgatggaagcagaaattttggttagaactcgtgaaatggatggcccacttgtcagctcagtgtttcctgatgtgctagtgaaatacaaggaagtttcaggtttgagaaaaatttatttattaata

SEQ ID NO: 666 - DNA, 318 bp, Halyomorpha halys
tcagaaaacaaattaacaatattttttacagctttatttatgaaactgaacgccataatggtattgcagaattattggagattttaggaagtgtcattaatggatttgctttaccattgaaggaggaacataaaatatttttgttaaaagtacttttgcctcttcataaagttaaatctttgtcagtttaccatcctcagctagcctattgtgtggtgcagtttcttgaaaaagatccttctcttactgagccagttattagatcattgttgaagttctggcccaaaactcattctcctaaggaggttatgtttttga

SEQ ID NO: 667 - DNA, 260 bp, Halyomorpha halys
agatgacctgggagccgaagaacaagacggatgatgatgatgaagctgctctctccgactgcgaggacaaggataaggaagattgcgatcaggacaaagatcccaggattccgaaagatgctacggaatcattcaaatctattatcagagtcgtgctagattatagattggaaaccgtggtcgttatcaaaggtcaaattagcaactttgaaatggtgccgttacgaatttggggaatggatgggttgaaatttctttcg

SEQ ID NO: 668 - DNA, 651 bp, Halyomorpha halys
atgattaatgtacctctttgtgttgttctaggcgcttgggcaacctttggtggaggcgtaacggaatccgaagctgaggcgatcgttgaagcagcttattatgccggtatcaacctgttcgacctgagcgaagctcactctggccccagggccgagatagagctagggcaaatactcaaaaggaaagcatggaagcgaacctcctatgttgtcactactaaagtatacttcaattcaaattggctgataactgatacgttgtctgataagttgtctgaagaaagaggcctttcccgaaaacatattatagaaagtgttaaggcctccttgcagaggctacagctcgattatattgatgtcgtcatcttacacaagtgtgatcctatgtgccccaccgaagagactgtgagggcaatgaaccatgtgataagccaaggctgggcaatgtactggggcacagctaaatggacacctgtagaaataatggaagcgtattccaattgtcgtcaattcaattgtataacaccaattatagagcaagctgaataccatatgttctgccgtgaaaaggctgagttgtacatggctgaactttataacaaaatagaaactaggaatttggcagaattgtatttgaggtttttaaagttt

SEQ ID NO: 669 - DNA, 564 bp, Halyomorpha halys
atgaaccggctgggaatgttagtcgatctgtcccacgtttccgtgcgtactatgaaagcagctttggaagcaacgaaggctcctgttattttttctcattcttcagcaagagctctttgcaacagtaccagaaacgttccagaccacatattagctaaagttagcctgaatggaggactggtgatggtcaacttttattcccaatttttgacttgcaaagaaactgcaaccatagctgatgcagcagctcacattaaccacatcaggcaagttgctggtgtggattgcgttggcttgggagctggctacgatggaattaattcaacaccaaaaggtttagaagatgtttccatgtatccagctctgtttgctgagttaattgcatctggacaatggaccatagaggaactaaagaaattagcagggcttaatctcttaagggttctcagggaagttgaaaaggtaagggatgatatggctaaagcaggtgttgagccttatgaagacaccatagcaccaaaatacctaaagggaagaagtaattgtacatcacaagaacccttt

SEQ ID NO: 670 - DNA, 607 bp, Halyomorpha halys
tatttttcttcgtaatagactcaagtatgcccttaccaatactgaagtgaccaaaattgttatgcaaagactgatcaaaattgatggtaaagtaaggacagaccccaactatcctgctggtttcatggatgtgatcagcatcgagaaaactggtgaattttttcgattaatctatgatgttaaagggcgctacgctattcacaggattactggtgatgaagccaagtataagctttgcaaagttaaaagagtgcaaactggacctaagggtattccttacttagtgacacacgatgccaggactataaggtacccagatccacttgtcaaagttcatgataccattcagctcgatattgctactggcaaaataattgatatcatccgaatggagtcagatgtaaaatgtcactacaatgtactaagcaacctttgcatgattactggaggtcgtaacttgggaagagtaggtactgttgtaaacagagaaagacatcccggatcttttgatattgttcatatcaaggatgctagtggacacacttttgccacacggtatgatacaaagcatcaagaacaatatatttttatattaaaaagtaagaaa

SEQ ID NO: 671 - DNA, 219 bp, Halyomorpha halys
atggagaagaatcttcctgattcttgtacttgtcctaatccatctgatccattttatttccaacctttctctattttatctgttgctatttgcagttgttatggatttaatgataaccataacttatctgtgattgtaatcataacttattaccatattaatagtggtatgacacaactagatggccataatgatacttctgatgaagaagaggaagag

SEQ ID NO: 672 - DNA, 236 bp, Halyomorpha halys
atgaagaagacaatgaagagaatgaaggaggtgctgaagaggaacccttgaattctggcgatgatgtaagcgaagaggatccatctgaaatgtttgagactgacaatgttgttgtctgtcaatatgataagattaccaggactagaaacaagtggaaattttatttgaaagatggtattatgaatcttgggggcaaagactatgttttccaaaagtcaaatggcgacgctgagtgg

SEQ ID NO: 673 - DNA, 465 bp, Halyomorpha halys
atgaagatcggtttgtgtgcgtacagtgggtataaaatttaccctggacatgggaagaccatggtcaaagctgatgggaagacatttacatttttaaactcaaaatgtgaagcttcccatctaatgagtagaaatcctcgtaaagttacttggactgtcttatacagacgtaaacataagaaaggtcaagaagaggagcaaagtaaaaaacgtactaggagaactcaaaagttccagagggccattgttggtgcatctctctctgatattatggcaaagagaaacatgaaacctgaagttagaaaagctcagagagaacaggcaattagggctgctaaagaacagaagaaggcaactaaggctgccaagaaacctgaaaaagtacctcctaaggttaaacagccttcaaagcagaaggcaacaaaggtgcaacagaaatctgctccaagagttggtggaaaacga

SEQ ID NO: 674 - DNA, 834 bp, Halyomorpha halys
atgtcctatgagtactttagttattgtaacatttatttcataaatggatccttctgctgcagattccctcgtgaacaagggactctaccaaaccacttctactttacggatttcgaaaggcacacagctgaaatagccactttccatctagacaggttactgggatttcgaagagccatgcctgttacaggaagaattctgaatataacatcagagatttatgaagtggccgacgatgagctgctgaaaacgttttttatttctccttccaataataagtgttttcatggcaaatgtagttattattgtgacacggcacatgctatatgtggcaaccccgacaagttagaaggttctttcgctgcattccttccctcaaaggaaatggctccgagaaaagtttggagacatccttggaggcgatcatatcataagagaaggaaagcacaatgggaacaagctgggtttcagataattcggcctataaaatctgattactgtaacctagtccgcgacatagcgccctataacagcgggcggagactgttggacatcatcgatatgtgcgttctcgacttccttaccgggaatatggaccgccaccactacgagaccttccggctcttcggtaatgatacgttcctacttcatttggaccacggcagggggttcgggtcgcacagccacgatgaattcagtatcctcgcaccgctacggcagtgctgtatcatcaggcactctactctacgttcaatcctcagtttggataagttctttccggagatgtctccttaccgatacacctctatcagctactacccgtcaattgagagt

SEQ ID NO: 675 - DNA, 523 bp, Halyomorpha halys
tttatgttttaaagatatgttatttcgttcgcatttatatttgatttttctgtttcaggcttacgagctatcgacgctgacgggcacgcaagtcatgttgctcgtagcgtcagagaccgggcatgtatatactttcgctacgcggaagttacagcccatgatcacctcagaggcaggaaaggccctcatccagacctgcctgaactcgccagatccgtgcccgtcatcctctggaggggaccagcgcatgtcggcgacggggttcgaggagacagagctgtcgtacaacatcggagaggaggaacagaaagtaaggcagctgtacgggagcggtaccgcgggcctgatgggcgggcaggggttggcccatgggtccccgcaccaccaccatctcatgctccaccagtccccgccaccccacctcatcccctgttctagccctgcgggctaccagcaagcctgtccatcccctctccctcattaccctccccatccccacatgccccattcacacccccagcgt

SEQ ID NO: 676 - DNA, 234 bp, Halyomorpha halys
ctgctgctgctattgcttatggattagataagaaagagggtgaaaagaatgttttagtttttgatctgggtggtggtaccttcgatgtctccctacttactattgataatggtgtatttgaggttgtttcaaccaatggtgatacccatcttggcggtgaagattttgatcagcgggttatggatcacttcattaaattatataagaagaagaagggcaaagatattcgtaaag

SEQ ID NO: 677 - DNA, 260 bp, Halyomorpha halys
aaagatattcgtaaagataacagagctgttcaaaaactgaggcgtgaagtagaaaaggcaaagagagcattgtcttccagccatcaagtcaggattgaaattgaaagtttctttgatggtgaagatttctctgaatccctcaccagggctaagttcgaggaattgaatatggacttgttcagatctactatgaaacccgtacagaaagttttagaggatgctgatatgaacaaaaaagatgttgatgaaattgttcttgt

SEQ ID NO: 678 - DNA, 208 bp, Halyomorpha halys
gagggtctccgatgatgacaagactaagatggaagcagctattgatgaaaagatcaagtggttagaagaaaaccaagatgctgatagtgaatccttccagcaacagaaaaaagagcttgaagaagtagttaagcccatcatcacgaaactttaccaaggtggagcacctcccccaggaggagctgaagaagatgttaaggatgaacta

SEQ ID NO: 679 - DNA, 328 bp, Halyomorpha halys
atggaaggtccaagtatcttgccccatccttctgatagctctgacattccaacatatgactatagtcttgcctgctatatattaaatgttaatattgaaaataccgttttctctgtcgtagatcaccaatctggaggtcagagtggtagctctggaagcacattgtcagattctgaagaagaacctaacagtcctactgtgcaaaattcactttccagtcctcaaccacaatctccactgaatgtcaaaccgcaagttttttttccttcagacaatatctcagaaccaaatacaaatggaagattactttgggattttcttcaacaac

SEQ ID NO: 680 - DNA, 235 bp, Halyomorpha halys
ggattttcttcaacaacttcttaatgattctttgcaaagatacacttcttatattgcttggaaaaacagagaagcaggagtttttaaaatagtagaccctccaggacttgcaaagttatggggaatccagaaaaatcacttatccatgaactatgataaaatgtctcgtgctttaagatattattacagagttaatattttgcgtaaagtacaaggagagaggcattgctaccag

SEQ ID NO: 681 - DNA, 843 bp, Halyomorpha halys
ttataatctggaagtacctttggattctgctaggcataatcttgcttcaacatttgtaaatgcttttgtgaatgcaggcttttccagggataagttggtatcagttgaagatggcaacaaatggatgtacaagaataagcaacatggtatgttaagtgctgctgcatctctcggtctgattcatctgtgggatgtcgatggaggactaactcccatcgacaaatacttgtatacatctgaagattatatcaagagtggagcattgctggcattgggtattgtgaactgtggtgtcaggaatgattgtgatcctgcgctggctcttctttctgattatgtccttcatgaaagtgtcactttgaggattggtgcagttttaggtttgggcctggcttatgttggaacaaaaagacaagacgccattacccttttgctgccagtgctctctgactcgagatcaacacccgaggtcgttgctatggcagcattggcatgtgccctcattacactcggtacacctcatcccgatgtagtatcaactatacttcaaactcttcttgatcttcctgtggctgagatgactgaaggacactactccaaatttttgccgcttgcacttggtctatgttacctgggtcaacgagaaggcacagaagctacaaaagctgctcttgaagctcttccagaacctttgcggtctctatcacaacacatgttgaagatgtgtgtctatgcagggactggggatgtacttgtcatccaggagcagcttcaagtgtgctcagaacattatcccactccagaagaaaagaaagaaactgataagaaggacaaggataagga

SEQ ID NO: 682 - DNA, 408 bp, Halyomorpha halys
aggataaggacaaggacaaagatgagtcaaagagtagtaaagtgaaggacatgacgtgtatgcaagcagtagccgctctttctgtagcagtgattgcaatgggtgaggagacaggatctgaaatggccacaaggatattcgcacagctgggaagatatggtgaacctgcagtacgaagagctgtgcccttggctatagcactgtcgtcaatatcgaatcctcagttagctgtgatcgatgttcttaataaatattcacatgaccttgatgaagaagtggctcacaatgctattttctccatgggcctggttggtgcagggactaacaatgcaaggttggctaccatgctacgccagctagcacagtaccatgctaagaacactggtcacctgttcatggtgcgcatcg

SEQ ID NO: 683 - DNA, 249 bp, Halyomorpha halys
aagatggaagaactctctctgattacaatatacaaaaaggcaagcttttttatattattaattttgttttgttgcttttaatcaactacttagttatattttttatatttgtggagaatgtttataatttttcacaacagcccaatgcttacaaatctactcttcacttggttcttcgtcttagaggtggcgtcattgaaccaaccctgaagattcttgctcaaaaatacaattgtgataaaatgattt

SEQ ID NO: 684 - DNA, 1411 bp, Halyomorpha halys
atggagtgctctgattttatgcagcaactgcgtagcttcaaaccacagtcacttggttgcgccgtagctagaagaaaaagttctactactctaatcttccctctccctcctcaagcttgttcagatgagttttgtgaagaatatccacataacttaattccgacccctggttattggattgagtgttcaagacaaaaaattgcctctgatactatatgggatgagagcgagtcagaaagagatgaagaaggagaagggggtgctgaaggtggcgatgagtaccattataggcacccacagctcctcgaggatgaagaagatgagccaagaaagaagagtgtgatcgaggaacagtgggaaaagaaccagtgcttcgagttgacatcagtcgaacaggagacctatgagaaatatttctatggacatgagcattggaactacttcacaaatgatgaagatcttggtcctgtgatcttaagtataaaacaggaaatgctaaatgggagggaccagtttaggatcttggttagagcaatcagttacacagctcatggcttgatcccagcatcttgtgtttttgctgatcgttacaatcgggaagaagtagttcgttccctcggaaaagaagtcaatcttaatcctcctcttacccttgggcaactaccagatactcctgaagagttgcttaagttagatcaggtcttcattaaatcggaactcaaagttggtgttatatatgttaaagaaggtcaatatatggaagaagaaatattagacaacaatgaaaatagcccattatttcaagaattcttacaaattttaggtgaaaaagtgaggcttaaagggtttgacaaatacaaagggggattggatacagttcatgaccttactgggctctactcaatttatacaaactggagaagtattgaaattatgtttcatgtatccacactcctgccatatgaaaaacatgatccacagaagcttcagaggaaaagacatattggcaatgatatagtgtgtgtagtgtttctggaagctgataatacttcattttctccatcttgcataaaatctcacttccttcatacctttattttggtgagaacatcaccaagaatcaagagaaaacctacaagatatgaggtgtctgttgttacgagggatgaagtgggagcatataagccatatttatgggaacaaagtgtttttgataaaggtccaatgttcagagagtggcttttgacaaaaattgtaaatggagaaagggctagttactcagcaccaaagtttgctagaatgcaggaaagaactaggagtcaaatgttggaagacatagttgctaacctagccaatcatgctgaaactggacagattcccaaaccctacagacgtggttcatggagaccaa

SEQ ID NO: 685 - DNA, 690 bp, Halyomorpha halys
gtggttcatggagaccaattggccatatgaggccttcaagtcctttattggattctgttagagatagatttgaagactatgatcagctagcaaaggatttcaccaaagctttcctcaattcagaacctaacatttctgttaatgcacaattgtttgatgttgttttcttggttggacagaacaagcaaaagcaaagcagactgataggagttagagctatacttggagttagaagcagagtgtttcaggaaatgctatatggaatacaaacaggttttgggtcacctcaagttcctgtggctgaattattagcgagagctgttccttctttaccaagccctcagaaacctaagagcagtaactttctacaagtaccagatattgaaactccaagaccaaaaagtgtaccaagctcgccgatggtaaagagagcattctcaaggcttggaacccttacagctggatggggcagatctataaggaaacaacattcccatttatcagctgatgacaagaaaaaatgggcttcctcacaagactgttccaaggctggaggttggttttggtttgaatatggacagcagcaagtttctgaggcttttggttcccagttgatgctttggaatgtgtcagaaaaaaaattaaacagagcacatactcaccctaatactaaagacaaagaaggaaaag

SEQ ID NO: 686 - DNA, 398 bp, Halyomorpha halys
aagatggaaaagataaagacaaacaagctccttctcaacttgctgtaccaagactgagtgtttgtgctgatgtacagaaagtagatagagccaagctagcgcaagttgagttctcgattatagagtttgatgctgataccttcagaatactgctggattatctgcatacaagctcatgcccccttacatgtgccaatattcctggactaatttgtgcagcagagcactatgatctcccagaacttcttcaagcttgttttcaccatgctaagcaatttcttcgtattgaagtggtttgctgcatgttatgctcactagaaaattattattggaggtacacatcagcttctgagttagtcaacatgatacttgcttttgtagaaactagagcacaccag

SEQ ID NO: 687 - DNA, 351 bp, Halyomorpha halys
atggttaatgttccgaaacagagacgtacattttgcaaaaaatgtaaagtccataagcttcacaaagtaacacagtacaaaaagtctaaagaaaggcatgcttctcaaggaaggaggagatacgaccgtaaacagcaaggttatggtggtcaaacaaaacccatatttaggaagaaggctaaaaccacaaagaaaattgtactaaggatggagtgtactgattgcaaatataggaagcaagttcccttgaagaggtgtaagcatttcgaattgggtggagataagaagcgcaaggtattatcattttttagtatagtttttaggcaatgtattcttcatagtattgctatc

SEQ ID NO: 688 - DNA, 470 bp, Halyomorpha halys
atggcaggtataccaggatacacagtgaatattgccattgaagctcctgttgaaaatcagattcaggagatatcttatgatgggcaggaattttatcagacgccccttactatgtctgaaagccttacaaaattggctgcaaagattgatttcagtaaaacaggatgtgaggatatcaaaaaagatcctgaaactagtgaaaatggagaagaagaaacatcttctaaagatgcctatcaatctgctatctggccgtgggattcagtcagaaataagttacgaaattcctacactgaaatttgtgtgctagcagatgttatatcaatagccaaggaaaagaggtatatggtatttgatcctattcctcaggagatgcatgagcaaaaatctatggctcaagccctggccggagccgcttcagtattgttaactgctgctgagaggttaagaacatgccaaactgaagctgc

SEQ ID NO: 689 - DNA, 1405 bp, Halyomorpha halys
atgccaaactgaagctgctcgcaacagagctgtacctgattttcatattgaattgcttcgcttaagacaaagttggaggctgaagaaagtgtcgaataccattattggagatctctcatatcgtactgctggaagtaagtatgcccagactggtttatttgaagttacaaaggctgaagatgaaccagaaacttcaggagaaggtagtcctgatccgggaggcatagctaggcctgcttctgctctgagagttattatcccatctgaattacaaggtgtagcatacatcggagtaattgtccagaaagatcaagaagacctttgttctgcttcaatcacttctcttggcgagagggctgtaaatcatccggatctccattggaggcaaaaacttgaatcagctcagaatgttttgttttgcaaagaattatttaatcagctggcaaaagaagcagttcagttgcatgctcctatccctcatatggttctgggaaatcaaataatggcttctatgtttcctggtgttcagctcattattcatttaactcatagcactacaggaggaaatgttgaaaaacgtgaaagtggtttcaaatccgaacatgatcacgttcttgaacattccttacatcagttattgagagaggttcatcatcgaaatacacaccatccgtttccgcatccatcgtctgcaccccttggtccatcaaagcgacgctgccttgccgggccaactgctgcagatagtcaaacgctactggaacaaattatccagcaagctcagcatttcttcctacgtattcgaacagagtatgtgctcgatacaatcatcaaagaagttaaggatcctattattgtatctcattggaacgctctgaattctcctaccgtttcatgtgtcaagatcaacataatgactcatgggtacgatactgtttgtcgaacttcccttgtcattcaggtagctgataaatcattaaaatgtgtttgccgtgatggccgtgttatgcatatgtcttatgaacttcaggaacttcgtgatcttatattttgccagcaccagataacagctgtacagcagcttgcccgatgcatgggctggcagtacctttctaacagtacccatctcggcatcggagcagtcgagcctctagggaatgcaagtagctgtatcttggcttcgccgatgggtgatagattaattgctgtacgatgcgaacctcaaggtgccgttcaagtgtcgattgctcattctcctaaaaaagatttctttagtgggcagttagttaaagagaggaagtgggaaaatttgggcggagcgtttaaggaagttcgttgggataaaatggaagggaagaacttcctgaacaaaatggaactcctcatggctagtcttactagctct

SEQ ID NO: 690 - DNA, 205 bp, Halyomorpha halys
atgccaagaggctccctgcttggcaacaccaaccctcttggaacgactacgtttaatgtaacaccatctatagaagctaattcatcttatcaggggcaggcaggaaggtttaattgctaccctaatcgatacgaacctcagtctatgtcaactccaagaaaaacgcctaggcctctagacctaacaccaccatcaccattttcac

SEQ ID NO: 691 - DNA, 480 bp, Halyomorpha halys
caccatcaccattttcacaagtgacacctatatgtcctccacagcagctgggatctcctcccttcaacagccggagtagcccagaagactcaggtatatatcattcaaatgtgcagtctgatttgaccaaatctagcaatgaacaaaataacaatagtaatgtatctggaatgttctgccccagcacagatcaagagatggccaacatccagaacctgtttgccctgaggagagagtctgacattatgaacaagataatagaacatacctcaaggctcctacttgctgcagttaattcacctgaaataaaatctgatgaaccacctcagttctcacagtcgcaggacaaaatttctcgctaccttccgccattaacaggtagccaacgtgaagcagcaatttgcacctggactggacaattacctgctagaatacatacgaaccctacctactcgtgtaaggtatttcttggtggtgtac

SEQ ID NO: 692 - DNA, 743 bp, Halyomorpha halys
tatttcttggtggtgtaccatgggatattacagagggaattcttgttcaagcctttagtaaatttggaacaatcaaaattgaatggccaggaaaagacatgccaaaccaaccaaaaggatactgctacataatttttgaggctgaaaagaaagtcaaagcgcttttggactgttgcatacatgacttttctaaaggtggcaattggtattacaaaatttcttcaaggaaaatgaaatcaaaagaggtccaggttatcccttgggctgtcagtgattccaactatgctcaagtttctcagaagctagacccgcaaaagacagtgtttgttggagctcttcatggaatgatcaatgcccgggctctggccaagattatgaatgatctctttggtggagtgatatatgctgggctggatacagacaagtataaatatcccattggctctgcaagggttacgttcaataaccatagatcgtatatgaaggctgttgtggctgctttcatcgaaataaagacttctcagttcacaaaaaaggtgcaagtgaacccctaccttgaagactcaccatgctcttcgtgcagtgtccagcagggtccctatttctgcagggaaatggtgtgtttccgttactattgccgtggctgctgggcccttcagcattcaacaagagcaatgcgctcccaccaatacatatccaggaactcgaagagctccaatatctctccaacagcgcatgtcctt

SEQ ID NO: 693 - DNA, 1144 bp, Halyomorpha halys
atgggggacctattcagaagcgagcacatgtctctgtgccaactcttcatccaaccggaggcagcttatgcatgtgtctctctcttgggcgaaatgggcatcgttcagttcagggatttgaactcagatataagcgcttatcaacggaagtttgtgagcgaggtgcgccgttgtgaagaaatcgaaagacggctgaggtacataggttctgaattaaagaaagatggagttacagttccagagctgcataagatgcctgctgctcccaacccccgggagttgactgatttggaggaacatattgagagaactgaaggtgaaattttggaaatgagccaaaatgcagtcaacttgaaatctaacttcatggaactaactgagctcaagcatgttctcgagaaaactgatgcattttttcaagagagtgtttgtttcctacagcaagaaggggatattttcaatcatgctcttatagtgtctggagatgaccgaggttcacggactcaactgggatttgttgctggtgttgtaccacgtggaagagtatttgcatttgaaagaatgttatggaggatctctagggggaatgtgctcttaagacatgctgatattgaagaactatttaaggacccagctacaggaaatttattattgaagacagtatttgtagctttttaccagggagaagagctgaaagcaagggtgaaaaaagtatgcatgggtttccatgctactctttacccttcccctgctacttctcaagagaggttagacatggttcaggaagtcaaaacaaggatagaagatttaaaattgattttaaaccaaacagctgaccacagatatagggtacttttaacagtggcaaaacagcttcccaaatggactacaatggtcaggaaaatgaaggctgtataccatacaatgaactgtttcaatatggatggtattcaaaaatgtctgatcggtgaatgttgggttgctagtcatgacttgcatcttattcatcaagcacttgcggatggagggaatgctgttggaagtacaataccttctttcttaaatgttattaaaactaatgaagaacctcctacttacaatcgaacaaataatttcacccagggcttccaaaacttgattgatg

SEQ ID NO: 694 - DNA, 214 bp, Halyomorpha halys
tccaaaacttgattgatgcttatggtatagcatcttatggtgaagttaatccagctttgtatacaattattaccttcccattcctttttgctgtaatgtttggagacatagggcatggttttattttatctctttttgctgcttggatggtgatttgtgaaaaaaaactaatgaaaaagaagtctaacaatgagatttggaacatattttttgg

SEQ ID NO: 695 - DNA, 1165 bp, Halyomorpha halys
tggaacatattttttggaggacggtacattatcctgttgatggggctgttctcaatgtacactggattggtttacaatgatattttctctaaatcagttaacctattcggatctagttggagacaaaactacgatcgatcgactgtattggataataccatgcttactcttaatccatcgactgatgactatagtacaaagccatatccatttggaattgatccagtatggcagcttgcttataacaaaattaattttttgaatacatacaaaatgaagatatctattatcattggtgtaatacatatgatttttggagtcttcctgagtataccaaatcatctacacagaggagacagaatctacattcttttagaatttttaccacagctagttttcctgttggctttgtttttttacttagtcatgctaatgtttttgaagttctttctttattctggagaatatgatcaaaccaacccattacgtggcattcactgtgctcctcaaattcttattatgttcatcaacatgatgttaatgaaatctcctactttacctggagctgataacaacagtagcggagatcagtctaacagtactttcgtttgtgacccatttatgtatagtggacaggatgctgtccaaaaagctctggtgggagttgctttactttgtattccaattatgcttcttggaaaacccctttatcttatatatttcaagaataaaaagcttgctcttgcagcgagttcaaatggagatgttggctgtgaaatgcaagcaatgaatggagctgttgctggtgtgtttgaagatggtgcagaagaagagtatgaagaggaaccagccagtgagatttttattcatcaggttatacataccatagagtatgtgctcagtacagtttcacataccgcttcatacctcagactgtgggcattatctttggctcattctcaactttctgatgtattatggaaccgagtactcacgcttggttttggtcatggtgactattttggtggaataaccttatatatcatatttgctatttgggcattttttacaataaccatccttgtactgatggaaggactgtcagcatttcttcatactctaaggctccattgggtggaatttatgagcaaattttatgctggcc

SEQ ID NO: 696 - DNA, 1604 bp, Halyomorpha halys
cagatgcttgtttaagcattgtccacagtcttatgtgtcatcgacaaggaggtgaatcagaaggatttgctaagcgtgctatagaaagtttggttaaaaaactgaaggaaaaaagagatgaacttgacagtttgattactgctatcacaaccaatggttctcatcatagtaaatgtgttaccatccaaagaacattggatggaagacttcaggttgctgggagaaaaggttttccccatgtgatatatgctaggatatggcgatggccagaccttcataagaatgaattgaaacatgtcaaatattgccagtttgcttttgatctcaagtgtgattctgtttgtgtcaacccttaccactatgaaagagtagtatctcctggcatagatttgtcaggtttaagcctacagtcaggtcctagtcgagcagtgaaggatgagtacagtgttgtacctggtacagctgaagttgatgatcaagttacagtacagcaccatgctccacagcccattcagttccatccgcagcctattcatggaaacaataatccaggaggtgggagcactttggtgaccagtactactcctgctcttgtatctcctactgattctcaaatggcccagccagcattttattcacccatgtcacaatcttctatagacactcccggaagtccagtcataaatgatactgctaatgtacaaagaactaattctcaaagccctgggccaacacagagtgaggggtacgcgagtcctacccagcaagcagcatggagcggttatactcttacttatactcagagtatgcaaccacctccacaccaacctcttcaaaatgcatactggaatcatggagtgggatctgaaatgggaataggaggtttactatcaagtcaaccagcccctgagcattggtgttctatagcttacttcgaacttgatacgcaggttggagagactttcaaagtttcctctacttcaccttgtgttactgtcgatggctatgttgatcctgaaggagcgaatagattttgccttggagccctaagtaatgtgcatcgtacagaacagagtgaacgtactaggttgcacattggtaaaggtgttcaactcgatctgaggggtgaaggagacgtgtggttaaggtgtctctccgatcattctgtctttgtgcagtcctactatcttgatcgggaagcaggaagatcacctggagatgcagttcacaagatttatccatctgcatatatcaaggttttcgatttgaggcagtgtcatacccaaatgcaacaccaagcagctacagcgcaagcagccgccgcagctcaagcagcagcagttgctggccacattcctgggccgcacagtgtcggaggaattgctccagcagttagtttaagctctgctgcttgtattggagttgatgacttgaggaggctgtgtattttacgtttaagtttcattaaaggatggggccctgattaccccagaagttcaataaaagctactccatgctggattgaagttcatttgcaccgagcactacaattattggatgaagttcttcattccatgcccattgatggtcctcgaggaatggac

SEQ ID NO: 697 - DNA, 448 bp, Halyomorpha halys
atgaaaacaccagaacaatgcccttcagttgtttctctgcttgccgaaagttacaacccacatgtacgctacggtgctgccatggctttgggcattgcctgtgctggtacaggactcaaggaagcaatcggccttctggatccgatgactaatgatccagtcaactttgttagacaaggggctctcattgcttctgcaatgattttgattcaacacacagaacagacatgtcctaaagtcaaagacttccgtagcttatatgctaaagtgattgttgataaacatgaggatgtcatggctaaatttggagctattcttgcacaaggaataatcgatgcaggtggacgcaacgtgtccctttcactggagtccagaactggacacactaacatgctagccgttgttggcatgttggtattcacccagtactggtattggttcccattgg

SEQ ID NO: 698 - DNA, 289 bp, Halyomorpha halys
ggtattggttcccattggcaccttgcttggctctagcctttactcctacaactgtcatcgcgctcaatcaggatctcaagatgcccaaactcgagatcagaagcaatgctaagccatcgatgtttgcctacccaccacctttggaagagaagaagagagaggaaagagagaaagtgactacagccgttttaagtattgcagcaagggctcgcaggagaatcactgcgcgccttgaaagttccaagatggaagttgatgaagaatctaagaaagaagaagaaaaagagaa

SEQ ID NO: 699 - DNA, 272 bp, Halyomorpha halys
aaaagaaggaagaaaagaaacctgaaccaaacttcgaaatagtaagcaatcctgctcgtgtaatgaaaaatcagttgaaagtgtgtagcctagtggactccggtagctatgctcctttgaaggagatttccatcggtggcatcatcatggttcgccatgtcaaagctggtactgaagaagagcagctcgtcgagccagttgcggcatttggcccaaaacctgatgatgaaaaggagccagagccaccagaaccatttgaatacactgaagaa

SEQ ID NO: 700 - DNA, 356 bp, Halyomorpha halys
gagaaattgtttcattgaagcagattcctgaaaaatctcctacaaagattaagaactttggaatctggcttcgttatgactcaaggtctggtacacacaacatgtaccgtgaatacagggacttaactgttggaggagctgtaactcagtgctacagagacatgggagcaagacatagagctcgagctcattctattcagataatcaaagtagaaatcgtgaaagctgccaactgcaggagacccttagtgaagcagttccatgattccaaaatcaagttcccacttccaaaacgaatccaacacaagaatcaacttcctttgttttcgacaaggaaacccaggacatatttctta

SEQ ID NO: 701 - DNA, 211 bp, Halyomorpha halys
atggctccacgtaagggaaagcagcaacaagaacaagtccaagtttccttgggacctcaagttagggatggtgaaactgtatttggtgtagctcacatcttcgccagcttcaatgatactttcgttcatgtcactgatttatccggaaaggaaactattgctcgggtaactggaggtatgaaggtaaaggctgatcgtgatgaagcttctc

SEQ ID NO: 702 - DNA, 260 bp, Halyomorpha halys
atcgtgatgaagcttctccctacgcagctatgttggcagcacaggatgttgctgaaaagtgtaaaacactaggaatcacagctctccatatcaagttgcgtgccaccggaggcaacaagaccaagactccaggacctggcgctcagtcggccctgagggctcttgcacgtagtgccatgaagattggcagaattgaagatgtgactcccattccttcagattctaccagaagaaagggaggtcgtaggggacgtcgtttg

SEQ ID NO: 703 - DNA, 421 bp, Halyomorpha halys
atggggccttttacactaacggaagaacagtgcattaaggtccaagatatggaagaagagtcatcaagcgatagtgaagaagacgacgagagagaatctcttggagagaaacaacaggcaacgccctctcagaaacagcaactgcaacaaaatcagtctgccgatggcaaaaaaccatccactcagccttcgatgcaacctcctctaccaccggctccagataaagttatcgtcaagaaaggctataatcctaagcagagtgacgaaaagatacctgccaacaaggtgcaggaacacatgagaatcggtctgttggatcctcgctgggtcgagcaacgagacaaacacattcaagatagaatcaaccaggagaccgtatacgctggaggttctgctattgaggccagtttgaaacaacttg

SEQ ID NO: 704 - DNA, 456 bp, Halyomorpha halys
aagaaactgctattggtaagaagattggtgaagaggataagaagaaagatgataaggtgacttgggatgggcacacatctagcgtggaggccgctacccgtgctgccagggctaacatcaccatcgaggagcaaattcaccagatacacaaggtgaagggcttgctcccggacgaggaaaaggagaaaataggtcccaagccagttccaggatctgtgagcacgagtacagcgaatccaatccctggtggtcccccgatagttgtccaagccaaggccccaccactgcccccgccaccaaaagtacctccactcccacctccagctccattgccacctccaccaggccttgtccctcagccacccataatgatggtacctgcaccacttcgtccgcctcttatggtaccacccggagcttttcccgtggtcgctgctactccatcagctttcatgg

SEQ ID NO: 705 - DNA, 233 bp, Halyomorpha halys
ctccatcagctttcatggctccaccaggaactgcaccacttccccctgctcctcagccaccgcctcaggtcactcaggttgggaacttgttgaagcacgttgcttccgctgctgctggggatgctgatgaagagcctatgaccaaaaagcccaaaactgaagattgtcttcttccggaagctcagttcctcatgcaacacaagagcccggtcaccttcaaagtggtggtacca

SEQ ID NO: 706 - DNA, 258 bp, Halyomorpha halys
aaagtggtggtaccacttttggcagacaagccggaatggaagttgaatggtcaagccttgacattcaccctaccgctgacagacaccatcgcctctgtcaaagctaacatttcagagacaataggaatgcctgctgccaagcagaaacttcagtgcgatggcatcttttacaaagattcaaactctttagcgttctacaatatctctcctaatactgtagtgtacctacagctcaaggaaagaggtggcaggaagaaa

SEQ ID NO: 707 - DNA, 233 bp, Halyomorpha halys
ttggttatggaagtaacaagaagactaggcatatgctgcctactggtttccgcaaagtccttgtacacaatgtcagggagcttgaaatgctgatgatgcagaacaggaaattctgtgctgaaatagctcatgctgttagttccaagaagaggaaatcaattgtagagcgagctcaacagctaagcataaggctcaccaatcctaatgcacgcctcaggactgaggagaacgaa

SEQ ID NO: 708 - DNA, 302 bp, Halyomorpha halys; identical to SEQ ID NO: 630

SEQ ID NO: 709 - DNA, 382 bp, Halyomorpha halys; identical to SEQ ID NO: 631

SEQ ID NO: 710 - DNA, 217 bp, Halyomorpha halys; identical to SEQ ID NO: 632

SEQ ID NO: 711 - DNA, 1604 bp, Halyomorpha halys
ggcccagcagcaacaacaacaggaccaggccaggatgctggagcgaatgcgagagagggagaggggttatcaccctcagcgatatttcaaagtggactatccaccacccccggctcatagcaaagtgaaacaacagccggaaaagccacaagcgttgcccaaggctgaacctaacttcagcctgtttggtggctgttaccctgcctatcaagcaccattgacttttctacaccatgaaaagaagcctgaaaccaagccagcattagtagtaaccaaagcagtagaggattcagtcaagaatactgtgatcgttaaaaatgataagtcacctggtcttcagccaccgagtcctaaattgagggagtaccttccgtctaagtctccatatgaatataggtcaccttcacagtcccctcatactggcccttatgaagttcaaaatctagccagtatatcgaaagttcatgtgcatcgacctcagcatttgtctcctcaccagaggcaatcacctcatagtcaccataggcagtctccacatcataggcagtctcctcaccacccaccttcacctcatttgcacccatctcctcccagcatcggctatacaaagcctgctactgttggttcttacccttatcctgctccagttatgtatgctgcaccaccaactacccctcctaaacccaaagttagcagtccatctccgcagatatattgtaagcccaggccattgagcaggagtgctgaggtacctaaaccccttacaccatctccttatcagcaggtctctcagcataatttaccacctccagctcagatggctagtactggtggtcttcctcctcctccagcagcacatgcagtcacaaaaggttatggcttagctgttaagcagcagccaccatcctctccaccaggtccaggtctggcaattacacctgcctttcaaacacagcctcttgatttaggtgttgccagggaaaccagtagtcctaagcgtaagtctgaaagccctcaaccagaagcaaagaaaatcaagactgaagaggaaccagtaattaataggaccagcgaatccagcccacttcctacaattactactataactccctcgccgcaaggcagagaatctccaaggccagttcataaactgaaaaaggcttggttacagagacattctggtgaagatacgaacacgactgaagatgttaaaggtgggggagtatgtgttacactgccaatgcctgtcacatccactgctgtggtgcagccatctgtatctcttcatagtataggaagtatggcagtcaattcgataaagaaacctaaacagagtcggaaaccgaaggaactcaatggacatgttccaagtaaaagtccagaggccgacgattcttcgtcttctgatcctgaaaggaaagctactcctcagaaacgtattccaccaaaggtgaaaaggaagaaggggggtagaaaaagtgtgcctgaagagactaaacggaaaaagactagtgtttctagtactgatagtgaaaaagaaagtggtagtgataaagaatctgacacaaacagcactgtgggaagtaagaagaaagaagagaaga

SEQ ID NO: 712 - DNA, 320 bp, Halyomorpha halys
gaagaaagaagagaagaagttagaaacagcagtcattggtaagaaaagggggaggcgacctaaatctacgccttcaaaaaacggaaatgaggatgagtcgcggaagtctaaaggttcttcagaggttgaatctttagtagctccacaacgcgactacatccagaaacctagcgtggggcagttaaagaaaacaggagaaagttttttgcaagatggaccatgttttgaagttgcaccgaaattagctaagtgtcgtgaatgtaggtggacccctaatcagaggaacaggaatatgcctaacattttctgcagattttatg

SEQ ID NO: 713 - DNA, 1973 bp, Halyomorpha halys
tctgcagattttatgcatttagaagattgaggtatacgaaaaatggacaacttgcgattgctggtttctcagatcctcacagggatgctttgccgggcaggaaaacaggcgcattgaaaacctggggagaaccagggcgtgaccgtgacgatgtttcatggctgctgtgtaccaataggcaagcccatgaacaggaaaaactgatgctcacacaaatcatagcaggggattcattagcacaaattggaaggagaatacacgatgccaggcattcgtggggaattccacaacgctgtgcatgctctgaatcgtcactcaatggtctggttaagaaatgtaaagaactaaatggcaccagtgataagaaaaatgatgaaagtaattctcctctttcatggttagcagatgtggcgctatctgaagacaaaaaatcaggttcatgcgaggacgtgagttctctgaaagaagaagaagacaaggaggcatattcgaccctgcgtgaactcctcattaggccaagtagtaaaagcaatggttccaggtccaattctcccgtcacaaggcttcctggcaaaaggcctccacatcttgaaacattagatcaggtcatcagtactgtgatcgaggcatccgtccctacagcaaaagatgagttacaaggaggagaattaaagcatttcattcggcgtttcaagaacatagccgcaaaggaaacattaccagcaagggtcatgacattgaccgaaagtaaacagctgtatcctggagtacctcattcttggttgtgcgatgggaggttgttaaggttacacgattcaaaatcgtccgacaacttcatagctttccaggatcagtggaaaagagggcagccagtattaatatcagacctaagtaaagaacttgatgaagaattgtggacaccagaatcatttttaagggattttggtgactcgaaaaatgatctcattgactgtagttcagggaacacagtttcctctcagccgatgaggaagttctgggaaggttttggttccatttctaaaaggttaaaagatgataagggacaacctatgatactcaaacttaaagactggccacctggagaggattttgcagaaatgcttccatctaggtttagtgatttaatgaaagttttgcctatgggagattacacccagcggggaggcaggttgaatcttgcatctcgccttccagaatgttttgttaggccggacctcgggccaaagatgtatacagcatatggttcaccaactgctggcactactaacctccatcttgacatatctgatgctgttaatgtcatggtgtatgttggaattccatcagatgttgatacggatgcttataccaaagatgcattaaaagccattgatgaggctggctgtgatgtgataacgaagcggcgtgtgagagagaagggccaactgccgggtgccctctggcatatctacatggctagagatgctgataagatcagggacctcctcaataaggttgctttagaaaaaggtgctcgtcttgaacctcaccatgatcccattcatgaccagtcgtggtaccttgatggtgagctgcgagataggttgtacagagaatatggtgttgaagggtataccatagtccagtgtcttggtgatgctgtgttcatccctgccggagccccccaccaggttaggaatttacacaactgcataaaggttgcagaagactttgtttcaccagaaaatgtgtcacattgtttccacctgacccaggagtttcgagagctatccgacactcacaccaaccacgaagacaaactgcagatcaaaaacatcatgtaccacgcggtgaaagactcattggctgttctagcagcagctgaaaaccagcaacagcaggatcagtcaagtgatcaagaagttaagaaagaacctgaggacagtatgtccaatgggcaacagtcagccacg

SEQ ID NO: 714 - DNA, 765 bp, Halyomorpha halys
gagaaagattaatggatgctatggtaaaggaaatgttgcataaaaaatcaagttatcgagaacaaataaactctgatcacaggctgaagatgcttctagatcagtatatggagagcactcataagctaaaggaactgtatgaagacaaggatggtataaggaaagatgaagttgctgcgctttcaggtcctaatgaattttctgaattttattcaagattaaagaccattaaggaattttatcgcaggatacccaatgaaatttctgttcccatgtctgttgaatttgaggaattggcgaaacttagagaaaatcctactgaagaaacatcaaatttagtagaatttaccgatgaagaaggatatggaaaatatctcgatcttcatgaatgctatgaaaagtacattaatttgaaaggagttgaaaaagtggattatattacatatcttactacatttgaccgtctatatgaaattcctaaagataggaagagttctgaatataaaagatatgttattatgcttctgaattatctttgtgattacattgctagaataaagccgctactggatctcgaccaggaattaactaatgttcaaaaggacttcatatcacaatgggaagctggtactttccctggttggccaaaagaaactggcagtgtgttaagcaacgttggtgcccatcttgacttatctgctttttcatctcctgaagaattggcctcccttggcttggacaggcttaaatcagcattaatggctt

SEQ ID NO: 715 - DNA, 290 bp, Halyomorpha halys
gttataattgtgaaatatgcggcaattttatctataaaggaccaaaggcctttcaaagacattttgctgaatggaggcatgcccacggtatgcgttgtcttgggattccgaatactgcacatttcgccaatgttacacaaatagaagatgctttggctttgtgggagaaactcaaaacaatgaagcacgatgaacgttggcagcctgaacacgaggaagaatatgaagattcccttggaaatgtagtcaatagaaaaacttaccaagatttaaagagacaaggactttta

SEQ ID NO: 716 - DNA, 493 bp, Halyomorpha halys
ctacaagtaccgacctcggaggaagcccaaggcaccaggacaacatccacagatgaagcccgcgggacctggtagtggaagtggccctttcgccagcttccctcttggaccatatttcgctggatctcaacaccaccacccgctggaaggactaggagcggcgtactctccgctgccgccctactttgggtctgccttcgacgccgtcaacttcagcaaactcgtccagaacggcagtcctcaggactccaacaaggccgccgcagtggtgagttccttttattcctcgctctatcctgggcaaaaatctttcggaccaccgcctccacctctctcagcgttgttccagccacctcctcctcattttctcttcggaggaggacagtccccaggttctagccctaccgagcaaggtatgacgccgtcttcatccacttcaggaccgccaccactcgacatggatacacttcgaaggcctgtgtcagtaatatac

SEQ ID NO: 717 - DNA, 846 bp, Halyomorpha halys
atgagtaggtcgtctcgaagtgataaattgaaaggaggtcacagcatgaaaagaagaagcacgagtagagattctcctcctattagaagcaagcggtctcggtccagtataggaagatatgatgacagttcagatgaaagattatcgcctgatcgtcttagacgccgaagtagggtaagatctcctcccagtcctcgtaggtatccttctcctagttcgcatagaagtgaatataggtctagagaattggaccgatcgtatcctagttacaaagtgttgtgtgttagtgcgttacatcccaaagcaagtgatgaagttattaaagacacattgtacagagaatacaaaaagttcggtgaactgagtattcgtatttctcatgacttagatgaaagggtagcttatgtgtgctttagaaattcagaagatgcccgagatgctaaaagaagtaagccaagaatcatcttgtttgacaaagttgcccttgtggaacctgtttatgagagtagaagttcttcagatccatatagacctcggagtagaccaagatctagaagcctgactcctgatcatgaccggtattaccgtagccctgaacatagggctcctgatagaagtgttgaacgtatgtatggacctcctccagttatgcagtatagagagtatcgacatgatgttctgtcaatgcatcacccagattttattcgcggccctcccatgcaccatgggataccaccacatattcctcctgtaccaccacaccattatggccctcctcgtcacatgattcatggatttcgcccacctccacctcattttgaacataaagtggaaaataaaaaagat

SEQ ID NO: 718 - DNA, 402 bp, Halyomorpha halys
ataaaaaagataaatttcctaactatttgcatcatgttcccccagaagatgacccccttgccactcgaactttatttgccgggaatttagaagtaaatatatctgatgaggaacttaggcgtatttttggtcggtatggggtagttgaagatatagatattaaacgcccattgcctggaactggtaatgcttatgctttcgtgcgctatcagaatttagatatggcacataggtcaaaggttgagttgtctgggcaatacataggtaagtttcaatgtaaaataggttatggtaaagctactcctacaactagaatatgggttggaggcttagggtcttggacatccctttctcagttagaaagagaattcgatcgttttggggcaataaaaaaaattgatt

SEQ ID NO: 719 - DNA, 908 bp, Halyomorpha halys
aagaaatgagaggatttccattaggaggtcctgaacataaattgcgtgttgattttgctgatgttaatcctgtaccaccaatgaaaccaaaaccattgcccggagaagaaattggtgctggagattttagagcccgggatgcatttccctatcctgatcctcattatgaagcctggggtgagggtgattattatggtggttccagaagtttcaggggtcgaggagggaacggcgggtggtctgataggaggagtagcaggtatcgctatggtgaagaagaatggagaaggtctgaggaatatgacagatacaaaagatctgggtctcgggacagatcacaacctcggtcagagggaagtgatagccataatggtcttttgggttcagttaggactttgtctgaactagcaaaaaaatgtgttacatcgtggaatggtgcgttgattttgaaaaactccttatttcctgcaaaatgtcatcttactgatggtgatagtgatattatagacagtttgatgaaggatgaagataacaaacctttactgagaatcactcaaaggcttcgtcttgatcaacctaaacttgaagatgtatctaaaagaatttcgagttccagtagccatgcgatattccttggtctctctaataacagctccacaagtgtttcaagtaatgatgtatcagttcaaacaagaccacttagaaatcttgtttcatatcttaaacagaaagatgctgctggagtgatatctcttgttaataaagacactgaagctactggagtgctatatgcttttcctccatgtaacttttctgctgatctcctcaaacgtactgcccagagtttaacagcagatgcattaaaagaagatcatttggttattgttgttgttcgaggaggcacagca

SEQ ID NO: 720 - DNA, 249 bp, Halyomorpha halys; identical to SEQ ID NO: 683

SEQ ID NO: 721 - DNA, 924 bp, Halyomorpha halys
atgggagatcataaaaatctaattcagaaaagtaaacttcaagatgataacagtgaagaaaaattacttcaaccatacacctacttgctccaagtacctgggaaacaaattagggcaaaattaactcatgcatttaattactggttggatattccaaatgataagctacatagtgtgggtgaaatcatccaaatgttgcataattcaagtctacttattgatgatatccaagataattcgatattgaggagaggaatccctgttgctcattctatctttggagttgcaagtactataaatgcagcaaattatgtgttttttcttgctttggagaaagttttagccctgggtcactctgaggcaactgcagttttcacagagcaaattctggagctccatagaggtcaaggaatggaaatttactggagggataattttatttgcccaactgaagaagagtataaaataatgacaatgaagaaaactggaggtttgttcatgcttgccgtcagattaatgcaactatttagtagcaacaaatcagacttttcttttcttggtggtattcttggtctttatttccaaattagagatgattattgtaacctctgtgatagggagtatgctgacaacaaaagtttctgcgaagatttaactgaggggaaatttggctttcccataatgcacgctattatttcccgaccagaagacaagaaagtatttaatatacttcgacagagacctaagaatgttgaagtgaagcgttactgcatctctcttttggaagaatatgggtcttttgattatacacgtaaagttcttgacgacttggaaaaggaagcgagaactgaagtagcacgattaggtggaaacccacgtatggattcattgcttgatgaaattgcaataagtaagagggctgtt

SEQ ID NO: 722 - DNA, 249 bp, Halyomorpha halys; identical to SEQ ID NO: 683

SEQ ID NO: 723 - DNA, 783 bp, Halyomorpha halys
atgggtctcatgtttgggtatgctacagatgaaactgaagaatgcatgccattgactgttgtattggcacacaagcttaacgaaagagttgctgaattacgaaggaatggtgttttctggtgggctcggccagataccaaagcacaggtaacctgcgagtataagttcattggtggagcttgtgttccacttcgcgtccacactgttgtcatatcagttcaacattcggaaaaagtaagcttatctgaactgcgttctgctgtcaaaaaggatgttatccatcaagtcatccctgccaagtacctagattctgacacgattgttcacatcaatccttgcggagagttcgtgcttggtggacctcagtgtgatgctggtctcactggaagaaaaattattgttgatacgtatggtggatggggtgctcacggtggtggtgctttctctggtaaagatttcaccaaagttgacagatctgctgcttacgctgctagatgggtagcaaaatctctcgtcaaagctgctctttgcaaacgttgtctcgtacaggtctcatatgccattggggtcgctgaaccaatctctatcactctttttgactacggtacgtcgacaaagacacaaaaagaactattaactattgttaagaaaaatttcgatctccgaccaggaaaaatagtcaaagacctaaatttgaggaaccccatttaccagaaaacgagtacttatggtcacttcggaagagaaatattcccttgggagcagcctaaggagcttatagaa

SEQ ID NO: 724 - DNA, 448 bp, Halyomorpha halys
atggaaattacagatgaaaatttacacacactctctaactacttaatgcagacactaagcccagatcccaatgtcaggagacctgctgaaagattcctcgagtctatagagataaataagaactatcctattttgctcttacaccttatcaataaagaagaagtccattttacgattcgggttgctggtgcgatcactttcaaaaattacactcgtagaaattggccaattaatgatgataacttagaaaacaagattgatccagaagatagaatacgagtcaaggagttaattgtagatgttatgttggttgcgccttctagtattcagaagcagctttctgaagcagttggcactattggaaaatgtgactttccaaaagattggcctgggcttctgacgaatatggtcgaaaaatttggtggaggtgatttccatgttattaatg

SEQ ID NO: 725 - DNA, 571 bp, Halyomorpha halys
tttccatgttattaatggaattcttcaaactgcccattctatattcaaaaggtacagatatgaattcaaatctcaaaagctatgggaggaaatcaagtttgtactggacacatttgcaaaacctttgactgatcttgctgtggcaacacaaaatctaacacaggtgcacgctgcaaatccagaagcccttagagttatttattcctcattacttcttatttcaaaaatattttactctctaaactttcaggacctgcctgagttctttgaagacaatatgaatgtttggatgccactctttcatacactccttactacggatgttaagtgtcttcaaactgatgatgatgaggaggcaggcatacttgagcaactgagatctcaagtatgttctaatgtttcattgtatgcacagaagtacgatgaggaatttcaaccatatctccagggttttgtcacggatatctggagcctccttgttacagtttctctccagcctaaaaatgatttgcttgtcagcaatgcactgcagttcttgtctacaattgccgagagacaacagtacagacac

SEQ ID NO: 726 - DNA, 1707 bp, Halyomorpha halys
agacaacagtacagacacctcttcgaagacaaaaatgttcttactggaatatgtgaaaaagtcattattcccaatatacactttcgagactctgatctggagctatttgaagataacccagaggagtatattcgaaaggacattgaaggttccgatgttgaatcaaggaggcggtcatcgtcagagctagttaaagtgcttgcaggtcactttcctgaaactgtcagaaccatttttggcactaggttacaggaaatgctcactgagtacaatagtgatccagctaagtggaggttaaagaacaccgctgtgtacattgtgacatctcttgctgaaaggggttcaacggcaaagcatggtgttacaaaatcttctgaccttgttgacctacatgattttgctgggcaatatattattcctgagctcaaaaaagaagtgaatactttgcctgttatcaaagcagattccattaaatatctcatcacctttaggagtcttcttgctccacaggtgctgatagctgccttacctgatatagtgaagcatcttacatccccaagtctcgtagtgcactcatatgctgcttcagctattgacaggctgttgacactgaaacagaacaaccagccattaataacacaagctctcctgcagcccatcgctggtgatatccttactggccttttcaatattcttaacttcaaaggttcagaagagaatgaatacgttatgaaagctataatgagatctttccacaccttggacgagtctgttatcccattcttagctgaacttctccccaagctgacacagaagctgactatcgttgctaagaatccaagtcgtccacacttcaaccactaccttttcgaaactatttctctctccattagaattgtttgtaaaaataatcctggtgctgtcagcgcatttgaagaagctctctttccaacatttcagattatatttcaagaagatgttcaagaatttgtgccttattgtatgcaagtgttgtctctaacacttgctcgaaggtcaccacctctaccaccaccctatgtcgccctctacccctgcctattgtcacctcagctttgggatagacctggctgtgttcgaggtctcgtctgtcttctacgttcctatgtcagggtctcttccaatgatgatttcaatcagacagttaaagttaatggccttcttggtgtatttcaaaagttgatttcatcgcgattgaatgaccatgaagggttctatctgatgcaatcactcatagaacactgtcctcgggaacttcttgatccgtttatgaagcaggtagttcttcttctcttccagaggctgactgcggccaagactaccaagatgttctcaatggtagtagagaggcttattactccagactgtcgtaaagtgtcaggttctgttgaaaggaagataaccgctgttggattatgccgccttgttgctgactcaaaacaggttttctctggaccgtactcagcctgctggccagctcttgctaaaagtgtcgttgaaatcttagaagccccagaagatgattctgtagcacccgaagatcactttgtagaggtggacaatttaccagggtatgaaccagcatatgtccacttgaccgcagtcggcaatgacaagcatgatcccatttcaggtaaactattcactgtctcacacaatttatattat

SEQ ID NO: 727 - DNA, 645 bp, Halyomorpha halys
ttgttgaagacataaataaaaagagggaaccacttccaaccatggaatctgtttatttaataacaccgagtgaaaaatctgtacatgcactcatgaacgatttcgcctcaccaaatcgtatcatgtacaaagcagcccatgtctatttcactgaagcatgtccaaaccctttatttgacaccctgtgtcatgcgagaatcgctaggtttataaagactttgaaggagataaatatagcatttattccgtatgagcagcaggtgttctcgctggatgctcctgaaacgttccagtgcttctacaacccaacattgagtaatagcagacttgcaaatatggaacgtattgcagaacaaatagccacattgtgtgccacgcttggtgaatatccatctgtcagatacaggagtgattttgataaaaatgtagaattagctcagatagtgcagcagaaattagatgcctacaaagctgacgaacctacaatgggcgaaggacctgagaagtctcggtcccaattgttgattctagatcggggttttgatgcagtctctcccctcctgcatgagctcactcttcaggcgatggcctacgatctgcttcctatcgagaacgatgtatacaagtatgaagctactgctggag

SEQ ID NO: 728 - DNA, 965 bp, Halyomorpha halys
atgaagctactgctggagctcctgagaaagaagttttgttggatgaaaacgatgaactgtgggtagaactgcgccatcagcatattgctgttgtctcacagaatgtcacaaagaatttgaagaaattcacagagtcgaagcggatgccacaaggagacaaacagtccatgagggacctcagccaaatgatcaaaaagatgccacagtatcagaaagaacttagcaaatattctactcatttacacctcgcagaagactgcatgaatgcttaccaagggcatgttgataaactatgcaaagttgaacaggaccacatgagaaatattgttcctatactcctcgaccaatctgtctctaattatgacaagatgagaatcatcctcctgtataccctgtccaagaatggtatttccgaagagaacttgaacaaacttgtccaacacgctcagatccagccacatgagaaacaggccattgtcaatctaggaaatcttggcctaaatgttgttgttgatggtactcgtatcaaaaagccatatgtgcctcctcgtaaggagcgtattactgagcaaacataccagatgtctcgttggacacctgtgatcaaggatctcatggaggattgcatagatgacaagctcgacctgaaacatttccccttcctggctggtagggctgcgtcctcaggatatcatgctcccgccagcgtgcgatatggacactggcataaagacaagggtcagcaaactgtgaagaatgtacctcgtatcattgttttcatcatcggtggtatgagcttttccgagatccgatgtgcctatgaagttaccaatgctgtcaaaaattgggaggtcataataggtaaaattttatatattctggtaattgtcttcaatatgcagctgaatctagcaattcttgaaaaaaaatttgatctgcgaaatgaagcagctgtccttttcagg

SEQ ID NO: 729 - DNA, 814 bp, Halyomorpha halys
tcctcaagaagtcctgcctaggggtcctggtctgcagcagaaggtgtatcttgcccaatggagacacggtaagccatgtccaaacagacagtgtagcggtcggttggagattctaccttgccgtggtcattgtggatatccagtgactcatttctggagacacacggagcatgccatatttttccagggcgtccacgaccaccagaggcccgaagccaagtccacatccgaagccaggaggagcctgggggccggcaggagggtgagaggactcgctgtcatcctcgacaaagactcggagctacccaataagataacaatgctcaacgaaaataagcggccatcctgtgaacttgaagcaactcatttcactccaatgccgtctccatcattgtccatcgataaaggttactcttgctcgtgcccgccattcgagtgcgcttgcgcagtgcagacacagcccctaggacacagtgggtgcggagggccagcactcagctacagcaccgaggagtggtaccccccgacagagcactactacccagagccctccattcctccaccctacgagataccaccattggggggagacctgtttcccccagaggaatccccaacgctgctggacctgggttctggtcttatccgcagcctcaaggagagtaccgaacaggcattccaaactgactggtatcctcaggatcccttctcagaactggatgtcctcaccggagagtcgtcccaagagtcctccaacgacttcgccatgttccagcagcatggttactattaccatcagaacactgttagtcac

SEQ ID NO: 730 - DNA, 432 bp, Halyomorpha halys
atgggggcttacaagtacatccaggaattgtacagaaaaaagcagtcagatgccatgaggtatctgctgcgaattagggtttggcaataccgacaaatgaccaagatgcaccgtgtcgtgaagccttcaagacctgacaaagctagaagattgggattcaagaataagcaaggtttctgcatcttcaggatccgtatcaagcgtggaggcaggaaacgtcccgttccaaagggtgccacttacggcaagcccaagagccatggagtcaaccagctcaaaccgacaagaagtctgcatgctatggctgaggtgaggttagtaatgataaacacaaatgaattaaacttatttttgatcatcattactttccatatctacgaccttcaattaattaatctgtggttaataataaacacctcattaattgttatt

SEQ ID NO: 731 - DNA, 636 bp, Halyomorpha halys
atgcaactgagatatttaatgctgaaggtgatttcaacttctgcagtcacagccgtcttttgcgtttccctcttctatacaatcgtcctccaggaaggcgagaccttgagcatcggatggttcctggaagccgcatctcctttcttttggataggactcgggatcggactgacggtgtccctgtccgttctgggggcggcccttgggatccacacaactggagtgagcatcgtcggagcagcggtcaaagctccccgcatcaagacaaagaacctcatatcgattatattctgtgaagctgtcgctatctacgggctcatcacagcaatcgtactctcgggaactatcgagaacttcaattactccaaggtcatggccgatcaagagctaaaggagcgcaattggttttcaggatacctcaccttcggcgcggggatgaccgtcgggatcgtgaacctctgttgcggcatcgcggttggcgtcgtcggatctggtgcggctttggcagacgcagctaatcccgcactctttgtcaagatattgatcattgagatttttgggagtgccattggtctctttgggctgattgtcggtatttatatgatttctgaagttaaaatgggtgataaaattaca

SEQ ID NO: 732 - DNA, 207 bp, Halyomorpha halys
atggagaattctttattatttttttttaagcataaaacatataacaaatcagttacaataacagggtttgatctaactaattataggcagtgtatgggaaaatggaatgatgcaataaagacaatgtatgaaaagtgcgccagtgtaggaccgagcaggtgtatgatagtttattatgaacaattagtgcttcaccctcatgcctgg

SEQ ID NO: 733 - DNA, 372 bp, Halyomorpha halys
cttcaccctcatgcctggttgtctagaatactagacttcttggaagttccttgggatgattctgtgctccatcatgaagatcacataaataaaccaggaggagttcagctttcaaaagttgaacgttcatcggatcaggttataaaaccagtaaacgttgaagcgttaaccaagtgggttggacaaatcccggctgatgtgattcgagatatgcccaacattgctccaatgctttcaaagcttggctatgaccccactgctaacccacctaactatgggtcacccgacagtgtggtggctgataataccagaaaagttcaggagaactctattctgtgggctgaaaaggcacagcagttattatcacaggta

SEQ ID NO: 734 - DNA, 204 bp, Halyomorpha halys
atgtcgatgctgagtacaaagctgatgcggaagcccagcttggagcgagagctgcaccgaggtagccctgccctggatagtggggcaggaagctctcggtctgacagccctcgacagctggctgagttaatggggcaccctcagctggcacggcagtactctccgagcggcttccctgagcaacctccaccgcctcctccacct

SEQ ID NO: 735 - DNA, 490 bp, Halyomorpha halys
ccaccgcctcctccacctcgctcaagcggcacaccacctccgcctccaccgccgcatgcgtacccccagctgctgaagcggatgtctccagcacctcggggtactagtccagtctctcgccagccaatggtcgttcagaacaacccacaagtgcagcagcagctctctcagcagatgcaagccctcgctctctatcctaacagtgagccgccgcctccttatcccctccccccatcctatactgcttctattcaaagtcgacaaagtcctacacagcaggactacaggaaatccccgtcttcaggtatctactctggaccagcctcggcaggttcacctagcccagttactgtgggaggtagcacgactcctacttcagtagctcggccgacgccgctccactcatggggtgcgaggcaggcaaagacccaacccccgatcatcatgcagtccgtgaagagcactcaggtccagaaaccagtcctgcaga

SEQ ID NO: 736 - DNA, 459 bp, Halyomorpha halys
agaaaccagtcctgcagacagcaatcgctcccacctcgcctccacctccgtcttatgcttcttctatacagcagaagcaaggaaaaccaccgactccagtgcctacgacagagcctcctagttatgccagtacaatgcaagccctggccgctcaacgctgcattgttggccaaccttactcggaagaagcaacagttgttgagagcggcaccacacctaaatcttctcccacggttcacctccctctccagcgtaagtactcacctgggggtgagcagcgagcagaaagcccggcatccaatgggggacaaagaacacctcctcttccacctacagcatcgtcttcggtaacgaaagcaaaccagaaccaaaatcagaacggtgacagacggccgtacaaaattgatcatcaatcaccaatccctgaaaggaaacatattagtaaagaaaaagaagaag

SEQ ID NO: 737 - DNA, 416 bp, Halyomorpha halys
gcaacatgtagaaaatgtaataaaatcgcataagcaaagggttttcagaaggatccaactggaaactgaaatgtctaaaataggtttaagcgaagaagcccaagcccaaatgaggaagatgctttcgcaaaaagaatccaattacattagacttaagagggccaaaatggacaaatcaatgttcgtgaagataaagcacattggggtcggggcttttggagaggtcacgctcgttaggaaaatcgataccaatcacctttacgcgatgaagactcttcgcaaggctgatgttctgaagaggaatcaagttgcgcacgttaaagctgaaagggacatactcgcggaggctgacaatgagttttatattgctgagctgacatgtgcagttgagagtgtacataaaatgggttttattc

SEQ ID NO: 738 - DNA, 293 bp, Halyomorpha halys
taaaatgggttttattcatcgtgatataaaacctgataatattcttatagaccgtgatggtcatatcaaacttaccgatttcggcctctgtacaggcttcaggtggacacataattcgaaatactatcaaaggaatggagaacatggaaggcaagactccatggagccaaatgaagaatgggtcggagctgaatgccgttgccaccaattgaagccgttagagaggagaaggaaacgagaacagcaccagcgctgcctcgcacattccctagtcggaacaccaaattatattg

SEQ ID NO: 739 - DNA, 575 bp, Halyomorpha halys
gaacaccaaattatattgcgccagaagtcctgcttcgaacaggctacacacagctttgtgactggtggtccgtgggtgtcatactgtatgaaatgctcgttggttcaccccctttcttagccaacactccagcggaaactcagtacaaggtgataaactgggagactactctccagattcctaaggctgctaaggtttcacccgagggcactgacctcatcctgaagctttgtacctctgccgacagacgtcttggtaagaatgcggccgaagtcaaagcccacccattcttcagttcggtagactttgagaagggtgtccgtcgccaagccccgcctcacatcccccgaatcaagcattcaacggacacttcgaacttcgatcccgttgaccctgataagcttaggaactcatcgtcagactcgtctaagtctgacgagttaagtgatagtggaaaaccttttcatggattttttgagttcacgttcaggaggttttttgatgacggtggtgcagcaccgtatccaaataaaattagtctcgacgatacagaaaaccagggtgctgtttatgta

SEQ ID NO: 740 - DNA, 760 bp, Halyomorpha halys
atgtttgcaaaatcaggggctatagccattaattatggcaaccaacaacaggtacgtggaatggctactctcaaagctatatctttacgattaaagtcagttaagaacattcagaaaataacccagtccatgaaaatggtgtcagctgccaaatatactaaggctgaaagggatttgaagcaagcaaggccatatggtgagggagcgaaatcattttatgaaaaagcagaagtggccccagtttcagaaagtccagataaaatacttatagccttgacctctgatagaggtttgtgtggagctgttcacacacaggtatcaagacagattagaactgaagtttgtgaagatcctgaacataccagagtgatttgtattggtgacaaatctcgagccattcttcagcgtttatttggaaaaaatattctgatggttgcaaatgaagttggcagaaaacctcctacatttctggatgcttcaaagattgctcaagaaacaagcagatataacttttcatcaggtaaaataatatataacagattcaagtctgttgtttcgtacacaacttccgagttacctcttttcagtcaagcagcgattgcagctgctcctaaattgagtatttatgattcgattgattctgaagtgcttcagagttacatggaattttcaatggcttcattactttactatgccatgaaggagggtgcatgcagtgagcaatcttctagaatgactgccatggataatgctagcaaga

SEQ ID NO: 741 - DNA, 346 bp, Halyomorpha halys
atgaaccctttcggagaaattagaaatagcaatttaacgtttacgggagggatattttcgaaaaatgtttctccagttgcaccaggaatatcacaaataactacccattatcaacaacaaatttccaaggatattgaagatttgacaaaactaatagtcgaatcagcccactcttcaacagcaaatccatttcaaaaactaccaaatcatgaatttgaaaaatacaaagctattgcaaaaattcagaatagtgtattgttcatgacaaatttgatacataagtcagaatggaatggactaagtgatatatcgctggaacacgatatattattacaccctagatatt

SEQ ID NO: 742 - DNA, 299 bp, Halyomorpha halys
caggacaaggttttgtagtttatccagtgaaatataaagccattgtattccgaccttttaaaggagaagttgtagatgcgatcgttactcaagtgaacaaggttggaatgtttgcagaaattggacctttgtcatgcttcatatcccatcactccattcctgctgatatggaattctgtcctaatgaaacgccaccatgctatcgttccaaagatgaggatgtcgtaataacagcagaagattttgcaattggaacgcttatggatgattacttagggtataaaagggtttctggagaa

SEQ ID NO: 743 - DNA, 218 bp, Halyomorpha halys
tggctgcagatgcagaaccacttgaaatcttattgcatttacctctattatgtgaagacaaaaatgtgccatatgtttttgtccgttccaagcaagcccttgggagagcatgtggagtttcacgacctgtcgtcgcttgttcagtgacagtcaacgaaggatctcagctgaagccacagattacaaaaatacaacaagacatagagagactcttagtg

SEQ ID NO: 744 - DNA, 482 bp, Halyomorpha halys
gaaaaatcaaaataaattttgatcatggtactacaactctgggatttgtttataaaaacggtgttattttagctgttgattcaagggctacgggtgggcagtacattggttctcaatcaatgaagaaaatcattgaaatccataaatatttggttggtaccatggcgggtggtgctgctgactgtgtttattgggatagggtacttgctaagcaatgccgcctttatgaacttcggaataagagccgtatttctactgctgcagcttcaaagctcatggccaacatggcattttcatacaaaggaatgggattatcgatgggcatgatgattgctggttatgacaaaaatggtcctagtctgtattatgttgattccgaaggtcagagaacaaaaggcaaagtttacagtgttggttcaggttctgtctatgcttttggtgttctagactccggttattcatttgatttagaagataatgat

SEQ ID NO: 745 - DNA, 303 bp, Halyomorpha halys
tacatgctcaagaagaagtcaaacgaattcagagtgtccctctagttattggtcaatttttagaagcagtcgatcaaaatactggaatcgttggtagcacgacgggttccaactattatgtgaggattttgtcgacgattgacagagaattattgaagccttcagctagcgttgctcttcataagcacagcaatgcccttgttgatgtactaccacctgaagcagattcgtccatttcaatgcttcaagcagatgagaagccagatgttcagtattcggacatcggtggcatggacatgcaga

SEQ ID NO: 746 - DNA, 279 bp, Halyomorpha halys
acatgcagaagcaggagattcgtgaggctgtggagttgcctttgacgcactttgaactctaccgccagatcggaattgatcctcctagaggcgtgctaatgtatgggccaccaggctgcggcaaaacaatgcttgctaaagccgttgcccatcataccactgcggcgttcatccgagtagttggatctgaattcgttcaaaaatatcttggagaaggacctagaatggttcgtgacgttttcagactcgctaaagaaaacgctcctgccatcatcttca

SEQ ID NO: 747 - DNA, 472 bp, Halyomorpha halys
tcctgccatcatcttcatcgacgaaattgatgccattgctacaaaaaggtttgatgctcagactggtgctgacagagaagtgcagaggattctattggaactgctcaaccagatggatggttttgaccaaaccacgaatgtaaaggttggtactgataatcatcatggatgtactgaatttaatgttattatagcagataccttggaccctgccctgctaaggcccggtaggctggacaggaagatagaattccctcttcctgacaggcggcagaagaggctcgtcttctctactatcacggccaagatgaacctctccgaggaggtagatctagaagactacgtagccaggcctgatagggctggaatgcatgctgttagagaaaatcgttatattgtccttgcgaaagattttgaaaaaggttataagaacaatattaaaaaagacgaatccgaacacgagttctataaa

SEQ ID NO: 748 - DNA, 277 bp, Halyomorpha halys
atggtagggaactattcttcttattttttcccctctcttgggactctcttcataatcggctctatttttacacctgctgtcccttgtggcaagtgcatctttacctgctccggagcctctgccgtgatgcacgcacgctacttgctatcacaacaggtagtgtatatccacagtaaagagaagccttttaagtgcggagaatgcggcaaaggtttctgccagtctaggactctggccgtccacaagatcttgcacctcgaggaatctccccacaagt

SEQ ID NO: 749 - DNA, 381 bp, Halyomorpha halys
cctgcgggaaagtcttccgacgcaactgcgatctgaggcgacacgcgctgacccatgctgttggtgacgtccctccagaacttcctgactccccggagaatctgactcaccgcccggacgaccgacggtcaccatctccaggcccgtcgtacaggaggcggtcaccgtctccacagacccagtgtcatcacccaacagagaactacacgatgcgcccgcaactatcggtgcgcaaggatctccacgcaccctcgacttcgatgttccggaggccggatcctccacctcctgaccctccggcttggatcaagcgggaagagcagcaaccgagcacttccactcaggagcaacccaagcagcaacctcctccgccaccaccac

SEQ ID NO: 750 - DNA, 315 bp, Halyomorpha halys
atgaccaagaaaaggaggaatggaggaagatctaaacacggtagggggcatgtacaagcagtccgttgtaccaactgtgcccgttgtgtaccaaaggataaggctatcaagaaattcgttatccgtaatattgtagaagctgcagctgtgagagacatcacagatgctagtgtttactcatcataccaattgccaaaactctacgctaaactgcattattgtgtatcatgtgcgatccactctaaagtagtacgtaatcgttctaaggctgagagaagaattaggacacctcctcagcgtaacttcccaagggtt

SEQ ID NO: 751 - DNA, 221 bp, Halyomorpha halys
taccgaggacgatctgggacggagaagagacatcctactgcttcaaggagaagagccgctccgtgttacgggattggtatgctcacaacccgtacccaagcccacgagaaaagcgggaactggctgaagcgaccgggttgacaacgacacaggtctctaactggttcaaaaaccgtcggcaaagggacagagcggcagagcacaaagaagggttactaatt

SEQ ID NO: 752 - DNA, 217 bp, Halyomorpha halys
agaagaaaaagaagggaaattttgatatagatgctgttttaacagatgttggtgatggttcagaaaaaaaaacttttaacctagatgaactagaaaatgctctcccagatggaggaggtactggaaagtccaatgctcctaatgatgttgcagatgatgcagggattgaggagtttaacttggacatggatttctcaaagacaaaaaagaaaaagaa

SEQ ID NO: 753 - DNA, 402 bp, Halyomorpha halys
aaaagaaaaaaaagaaggatattgatgaattggttgcagatgaagaaaaaaaagaaggagatgagaaagaccttgaaaatgagagtcagaaatggtttggaactgacagggattacacctatgaagaactcttaaccagggtttttgatattatgagagataaaaaccctgaaatggtagcaggtaaaaaggcaaaatttgttatgcggcctcctcaggttgttaggattggaactaaaaaaacctcttttgctaacttcgcagatatttgccgaacgttacatagagttccgaaacatctcttagattttttattatctgaattgggtacaagtggatctgttgatataaacaatcaactgattattaagggaagatttcagcagaaacaaatagaaaatg

SEQ ID NO: 754 - DNA, 208 bp, Halyomorpha halys
gaaacaaatagaaaatgttttacgaagatacataaaagagtacgtaacatgtcatacatgtcgatcacctgatactatccttcagaaggatactcgactattctttctacagtgcgagacgtgtggttctaggtgctctgtagccagtatcaaatctggatttcaggctgtcactggcaaacgtgctgccatcagagcaaaaacaacc

SEQ ID NO: 755 - DNA, 382 bp, Halyomorpha halys
atggcaccccctcagcacgactccaagccgccccactctaaggagcagagcctcagctgtgggaggtcagaaagatcagggttgcagtctcactcacaagagctgaagtgtccaacacccggctgtgatggatcaggtcatgtcactggaaactactcctcacacaggagcctatctggatgcccacgtgcgaacaagccaaaaagtaaaccaagggatgggcaagactctgaaccattaaggtgtccaatacctggatgtgatggttctgggcatgctacaggaaaatttctttctcataggagtgcatctggttgcccaatcgctaatagaaataagatgagagtccttgagtctggtggtactgtggagcagcacaagg

SEQ ID NO: 756 - DNA, 351 bp, Halyomorpha halys
cctctccctccacctcctcccccgccggccaagaaacctcaggctcaaatgaagtatacagatgacatcagtggaggaccagtttataataaacaccaaacaaacggggccggtggtaattctgaggacctgttcactctagaggctgagatctcagagttacagcgagagaacgccagagtggagagtcaaatgcttcgcctcaagactgacatcactgccatggaagcacacctccggcatggacctcaatctgctgacaaggagagtactggcggtgggctcaactgtcctcaaccacagcggcagctcctcggctccgcagcaggtaccaataacaacaccagcagc

SEQ ID NO: 757 - DNA, 1558 bp, Halyomorpha halys
atgaaagttctgctcctactgctgggggcagcgtccctggcgagtgggcagagcaactacgccagccaaggcaacagcatcgagtacagcaacgaaggacttccggattcgacggtgctcgatggaagggtcaccaagttggacgacctgtccccggtcatatccctcaacaggacgaaggcttctctgaattgcgcggccggacagatgcagatcgagctacgattcgatgaaccattctatggcattgcttacgctgacttcaaccgtgccagtgcttgccagacgactggaacaggaaacctcacagctagaattgacctgccgcttaaaggatgtggaaccaaacaggatccccagcgcgtgttcacaaacaacatcgtggtaaggttccacccctcgctggagatggatggagacgaggtaataaccattgtctgcagatacccgcctccggttgccccacctccagcaggagtacctggatatataaaagaagatcctgcacccgctctcccactggccccgccgctgaaaggcttccaaatactcttgatcatctgcggaatcctcttcctctccctggtcctcttgggactgggttgctcctactaccttttgaggagaaggagggttcaggtggtgagaaggcaccccttgtcgacgggaggcacagggtccgaaatcactaaactgtctggatccagcctgggaaacatatcgatgttcgaagggctcaagattcctcgagcccatgctaccggtggtggtagcacctcgggatctgaagctgctctcatcagtgatacccttccatctgactacccgtcagagtcacccagttcaacacattcggaagtagagcatgtcgacaggagatctctgagttcaggaggttcatatgagaacaaagcttatgtacaggacagctattacacagaagagattgcacagacgacggaatcacaaatgcgacacctggctcataagagactgcccccagaacctaagttcgatgttcaagtgagagtaaagaaggctgctcccccacctccgacaccaacgcctcccccttcggaatcagaaatgagtatgaagatgacagaacgcaacctgactaccatcctggaagaaggaagaccagtgaagactactttcacctacgtaccagagatccatagtcctccttcaccggccaagttggcatcttcacccccagtatattccacaataattagaaaacatcctgctgagagcaagaacgttgctatggttgaagaacgatacatgagagaagatatggtggactacaggagaccatctgtggctagtgatcatactgaaatgactgaatccagatcaatgacagaggttgtagagcgcattcctaccaaaatatcacctcctcctccaatagtacctcagagctatatgagagagagcatggaagagtccgtagatgtaatcgaacctccagtggttgtttctcgaagaccagagataaaatcccatgtagttgatgatgtcttccttagaacgattacagaaaagaagacaa

SEQ ID NO: 758 - DNA, 1124 bp, Halyomorpha halys
ttacagaaaagaagacaatcgaagatattgaaagaaccagacgacaggttactgattaccgcaaaccgcctccggccaagtgggatgtcaccattcgcaattatcctggtccggaaggcccaggggctgaagattcagcaacagactgggaaagttattcggaaacctcatcaatatcaaacgtccccaatatgcaacctcaatacagagcacatatgcaaaattggcagcaacgaaggacagaaatagaaatggagaatatttacagatctaaaatgaatacaccgccaccggagaaaccacataattgggacgtactccttcgtgtcctggagccacctcaatacgaatctgcagacgacagatctgatgtagaaagcctcgcttcagtccttacaatcgatgataaaaagaagtggcatgaaattatcactacagaatcaaacctacgcacaatgctaagtgaagcaacagtaaaagaagactatgagagaatcagaaaagatcaacgatatgaaaaactatttgatccacagaagtgggatgtcatcatccgcgtacttgccccacctgcagaaaaaccgcagtatgatcaacgcggtggtggaggcagcaacaagtacaggaggaaggctgactgggacacccgcagcaggaggagctcgctaccaacgctctatgaatacgactccgatggcggatcctccatgaggaccttgacgacggaaggcggacatgggccagccgttgatcccctacgctctcgaaggacatccagatcatcggagatggaccttcgctcgatgagtgaagtcactgttgatatgagagcacacattcctgacaatgtgagtgatgtcagctcttactatcagcgaagatactatgaggaggattatgaggacgcccgcagcctccagaggtcaatgagccagccctctctggccagatccggatcagagttcacagagcactgggcagtgcggtcccgccattgggaaagtccagaacattcgcccaagtctgcaagatcttctaggactaggggatatagggtctctgaggcaagataccagagaacctcaggatggttcggcgatgctgaaagtgaagccagctacaag

SEQ ID NO: 759 - DNA, 351 bp, Halyomorpha halys
atggcgcctaaggctcctaagtatgaaatggccgttggccttaaaaaaggccacagaactaccaagattgtaatgggaaaatctaaagcagataaaaagcacaaagttaggccatctcgcttgaagggcagacaaactaagcataccaagtttgtgagagatctaattagagaagtttgtggccatgcaccgtatgaaaagagaggaatggaattgctgaagatttccaaggataagagagctttgaagtttttgaagaggaggatcggcactcacatccgtgctaagaggaagagggaagaacttagcaacattcttactcagatgcgtaaggcacatgcccaacaaaaa

SEQ ID NO: 760 - DNA, 424 bp, Halyomorpha halys
ccacaacttcttcaaaatgaagctctcagatgtgcgggagctctttctgcaacatcttatgccacagctgcaaaaggagcccagggaaaagttgttgctgtcattggtgccgttgtagacgtccagtttgatgacaaccttccacccattctcaatgctcttgaagtacagaacaggagcccaaggctggtccttgaagttgctcagcatcttggtgaaaacaccgtccgaacaattgctatggatggtaccgaaggtcttgtacgaggacaagatgttcttgataccgggtttcccattaggattcctgttggtgctgaaacactcggcaggatcatcaatgtgattggtgagcccattgatgaaaggggtcccattacaactgacaaatatgcctcaatccacgctgatgctccagaattcg

SEQ ID NO: 761 - DNA, 234 bp, Halyomorpha halys
ctgatgctccagaattcgtggacatgagtgttgaacaagaaattttagttacaggtattaaagttgtagacctcttggctccttatgccaaaggtggtaagatcggtctttttggaggagcaggtgtaggaaagactgtgttgatcatggaacttatcaacaacgttgctaaggcccatggtggttactcagtatttgccggagtcggtgagagaactcgtgaaggaaatgatt

SEQ ID NO: 762 - DNA, 541 bp, Halyomorpha halys
atgaggggacaagccaaaatagtttttatgatatttgaatctgctcaatgtggccttgattcaacgcatttaatcctttttactcgtataatactaagcagtttgttctttttcttttgtagtagaaaaattgtttcatctattaagtaccagaatttagtaaaatcagaggtctatgaagaactgaaaattattggtgctgattcagccgagccgcgagcgagaaggatacttgctggtcttggattttcaaagtctatgcaggatcgtgctactaaaaacttctctggtggctggaggatgagggtttctctcgccagggctttattcgttgaacctacacttttgcttcttgatgaacctacaaaccacttggatctaaacgctgtcatctggcttgataactatttgcaaggatggaagaagacccttcttattgtttctcacgatcaaagtttcttggataatgtttgcaatgaaataattcacctggatacgcttaaattatattattataaaggaaactattccatgttcaaga

SEQ ID NO: 763 - DNA, 694 bp, Halyomorpha halys
ggaaaagaacaaaacaaagttacagaagagggaagaagacaatgggccgatagaacttcttcaaaaaccaaaagactacattgtcaaattttcgttcccggatcctccccctctgcagccgcccatccttgggcttcacaatgtcgatttcggctaccctgatcagaacctgctgttccgccaagttgactttggtatagacttgagctctcgagtggccatcgtcggaccgaatggtgtcggcaagtctacgttccttaaactgctcactagtgatctagcccctcacagaggcgaggttaaaaagaaccataggcttcatataggcaggtttgaccagcattccggtgagcatttgacagcagaggaaactcctgcagaatacttgatgaggcttttcaatcttccctatgagacagcgagaaaagttctagggacatttggcctttccagtcacgcacacataataaaaatgaaagatttatctggagggcaaaaggctagggtggcacttgctgaactctgtcaaactgctccagatgtccttattcttgtaagaagattactagttatattagaggccactcaggccatcttcctacattccactttcaccttctcatccagattcaattctacatcatcaaagttttacttgagtgctgtctatgaattctgcccttattttccaaaa

SEQ ID NO: 764 - DNA, 210 bp, Halyomorpha halys
atgcctagggagatcaaagaaattaaggattttttgctcaaggcaagaaggaaagatgcgaaatctgtaaagatcaagaaaaatccagaaaatgtgaaattcaaggtccgttgctcgaggtttctttatacccttgtgattactgacaaggaaaaggcagagaagcttaagcagtcgttaccaccaggccttcaggtcaaggaagtgaag

SEQ ID NO: 765 - DNA, 216 bp, Halyomorpha halys
atgtgtttgaagttagatgttattgctgcagaaggtgaacaaaaagcaagtcgtgctctacgagaagcttctgaagttattggagattctcctgctgctcttcagctaagatatctgcagacactcaataccatttctgctgagaagaattcaaccattgtatttcctctcccgattgatatgctaacatacttcatgaaagcaagagaagcattt

SEQ ID NO: 766 - DNA, 583 bp, Halyomorpha halys
atgtcatcaagtaccattgctctacagggcttacctgaagaaaagatagatatgctggctgcgaccagtgttttgcagcagcaggcatcagaaatccggggttacagagtgaactggcagtcttacttgcagtcccaaatgataactcaggaagattacggaataatatctgaatttgatcatggtgatgctgctaaacgagaaaaaataattctagagaaaaggagtcagcttgcaaaaacatttttgaacttgctggaacatgtatctaaagatcagactatacaatacatattggtaatcatcgatgatatgcttcaggaagatcataagagagttgagattttcagagagcattcattaagaaaacgcgaacctgcttgtggtcaatttctgaatcttcttaatggatcagatggattcattgtcaatatgacagcaagaattattgctaaaatagcttgttggagcaatgaattaatggacaaggcagatctcaacttttatcttacttggctgaaggatcaactaaaaattactaataatgaatacatgcaatctgttgcacgttgtttacaaatga

SEQ ID NO: 767 - DNA, 318 bp, Halyomorpha halys
gttgtttacaaatgatgctacgcattgatgaatacagatcagcctttatttctgttgatggtatttccacacttctcagtgttttgtctggaagagtgaattttcaaattcagtatcaacttattttttgcatttgggtattgacttttaatcctaaattggcagaaaggatgaacaaattcagtgttatccctatcctggcagatattctaagtgattctgtcaaagaaaaggttactagaattattctcgctgtgttcaggaatcttatagaaaagccggaagacagagctatttcaaaagaacattgtatagcta

SEQ ID NO: 768 - DNA, 482 bp, Halyomorpha halys
aacattgtatagctatggtgcaatgtaaagtattgaaacagttgagcatcttagaacagcgtaaatttgatgatgaagacattgttgaagatgtccagtttttgaacgagaaacttcaagcttcagttcaggacttaagctcttttgatgagtatgcaacagaggtcaaaagtggtcgtttggagtggagccctgtacacagatcatcccaattttggagagaaaatgcagctcggctgaatgaaaaaaaatatgaattattgcggattcttgtccaccttttggaaaccagcagggacgcacttgtgctaagtgttgcgtcctacgacattggcgaatacgttcggcattatccacgtggaaaaaacgttatagagcaacttggcggcaagcagttggtaatgcaattactatctcatgaagatcctaatgtacgctatgaggcattgcttgctgttcagaaactaatggtgcataattgg

SEQ ID NO: 769 - DNA, 680 bp, Halyomorpha halys
tgtttccctccagagctgcctcgcctctgttctgcaagacagcagatgacgtaagaagaccaggtcacggcgaccaagagaaagtcctccgctactccgtggaccatcccctcatcctccacaactgtccccatcaagaaagcggagaggcttacacaggcggagggggaggatacatgggacccccgaccaactactttgcacaacctcaacctccatcacctcccagggcgtctgtcatccaagccgccgcctccagctcccacgacgacttctatctccttgagctcggtctccagcacaggatgaagaagaaagtcaaaagatccagaagtggcgacagtccaacagccactgggcccaagcgcaagtcacgcgaaggttcaacaacatacctttgggagttcctattaaagctgttacaagacagagactactgcccaaggtacatcaagtggaccaacagggagaaaggtgtcttcaagctcgtcgattccaaagcagtatctcgcctttggggtctccataagaataaaccagatatgaactacgaaaccatgggaagagctctcaggtattattatcaacgaggaatattggcaaaggtggatgggcagaggctggtctaccaatttgtcgatgtaccgaaagatattgtggaaatagactgcacaggagcg

SEQ ID NO: 770 - DNA, 439 bp, Halyomorpha halys
atggtatacagtagtgacaagttcttggagttcaaagttgtaatggcttttcgtgtgcttaatataaatgttcccattttgaagaaatctctcagtttccctgctttgagctatcacaaaaatgttatagatcattatgaaaatccacgaaatgttggttcattggataaaaatgatagcaatgttggaactggtttggtaggagcaccagcttgtggagatgtaatgaaattacaaataaaagttgacaaagatggtaaaattgtcgatgccaaattcaaaacttttggatgtggttctgcaatagcatctagttctctggctacagagtgggtcaaaggtaaaacggttgatgatgcattaaaacttaaaaattctgatattgcgaaagaacttgctctaccacctgtaaaattacattgctccatgctggctgaag

SEQ ID NO: 771 - DNA, 813 bp, Halyomorpha halys
atgactctttctagtttaaccaccctcgaaaagaaggtcactattgttgataacacagaaaccaacttgatatcactcagaaaaactatctatctaacaattcaatcgagtcttgattttgaggaatgtgctcataagttgttgaaaatggaaattaagcctggacaagagaaagaactttgtcatatgtttctagattgctgtgctgaacagaggacgtatgaaaaattttttggtctgctttctcaaactgggaatatatacaacactttggtgcgtttctgccaagtaaataatacttacatagcacctttcgaacagatatttgctgatacatattcgactgttcatcgcttagacactaatagattgcggaatgtggcaaaattatttgcacatcttctcttcacagatgctatttcttgggcagtgctatcaaatattcgacttaatgaagaagatactactagctcaagcagaatttttatcaaaattttatttcaagagttatctgagtatatgggtttggttaaccttaatgcgagattgaaggatccaactcttcaatcagccatggaaggtctatttcctagagacaatccaaagaacacacgattcgccatcaactttttcacatctattggtcttggtggtcttactgatgaactgagagaacatttaaaaaatttacctaaatccattcctgtgtcacaactcattcaagaattgtcatctgcatcctccacttcttcatcgtcttcatcttcatcttcctctgaaactgagtcttcatcgtctagtgattcatcaggt

SEQ ID NO: 772 - DNA, 626 bp, Halyomorpha halys
catacaagatttatcatttggctagtaaagtcccaacattcattcgactcttagttccaaaaggagctttagaaattcacgaagaagcatggaatgcctatccatattgtcgtactattatcacaaatcctggctatatgaaagaaaattttagcattttgattgaatcttaccatattgcggacaggggaactcaggagaatgttcatgaactgtcagctgaaaaacttaagaaacgagaaatagtaacgattgacattggaaatgatcctatcaatcaagctgattataaacccgatgaagatccatcaaagtttacatcgcaaaaaactggtcgtggacccctgcaagccaactggattgaatcagtccaaccagtaatgacctgttataagctcgtaactgttgaattcaaatggtttggacttcaatcgcgagttgaaaattttattcaacgttctgaacgtaggttgtttacaactttccaccgacagctattttgttggatggatcgttggcatggattaacaatggaagacatccgtagtattgaagaaaagacaaaggaagaactggatagacagcgtaatgttggtgaagtcagaggaatgaaggcagatggtgat

SEQ ID NO: 773 - DNA, 1569 bp, Halyomorpha halys
ttgaatcaacttctacaacagataaagaatctccaacagcttatgcaacaccatacagttatgcaagttaatcctcttggtaaaccaagctcaaatcatctgttacaattatctgtacagattacgaagactaagcaacagattaccaatcttcagaatcagatagcagcgcagcaagctgtgtatgtcaagcatcaacagcacactccaccaaccaccgaatttttcaagagttcattgcatgaaccaatttctggtcttcatccaaatttttctgatctttctctcaaagatcctccgactagtggaactagtcaacagtcacgattaaatcagtggaagttacctgcacttgaaaaagactcagatattggttcaggtgaattttcaagagctcctggtacaactgctaagtcagctcagggctcctcttcacccaataccaatctattacttgggcaggctgatggtacctggtcttctgtaaatcgtgagtccagttggcctgattcagctggtgatgatgcatctggtaaggattggccaaattccagtcaacctccatctcaagcattctctgatcttgttcctgagttcgaaccaggaaaaccttggaagggcaacccattgaaaagcattgaggatgaccctagccttacaccaggctctgttgtgaggtctcctctttccctaccttcaataaaggatacacacatattatcaactagtactggagctggcaaagcctcacctaccaccagctcctccttggatatcattccttctcttggcttatcatcctctacttggagctttaatccacccccatcttcatctaacactagtgtgaagctgaattctagtggagcaggtggaggtggtagtggatcaacatcaaataatggtggaggaaaaaatagtgcttcaacttgggaaactaattcgtctgaattgtgggctcctaaaagaggacctcctccaggtttaccagccaaacctactggtggttccagtggtgggcaggctactaatggttggggaccactgtctagcagcggccgttggtctactgggcaaggttggcctgggcctaatcaggcagctgctactcagccaggctcaacttggttgttattgcgcaatcttactcctcagattgatggttcgactttgaaaaccctatgtttacaacatgggcctctatcaaattttcatctctacctaaaccatggcattgctcttgctaaatatgcttctcgtgaagaagccaataaggcccagggtgctctaaacaattgtgttcttggcaacactacaatttttgctgaaagccccagtgagactgatgtgctgtcattacttcagcatcttggtgggcaagggagtgctgctagcggcagctcagcctggcgcggtaaggaggcctggggcaattcccagctttggggagccacaggagcgagctcaaccgctgcttccctgtgggcaggagatagtgatcaacaccgcaatactccatcctcgataaattcatacttgccaggtgaccttcttggtggtgagtccatt

SEQ ID NO: 774 - DNA, 295 bp, Halyomorpha halys
atgacagaaggtttgttcctatttcagattgacttagaagaaactggaagagtactcagcattggtgatggtattgctcgagtttatggtcttaaaaacatccaagcagatgagatggttgaattttcttctggtcttaagggtatggcattgaatttagaacgagacaatgtgggagtcgtagttttcggtaatgataaattgatcaaagaaggtgatgtagtaaagaggacaggagctattgttgatgtaccaattggtgaagatctccttggacgtgtagttgatgcccttg

SEQ ID NO: 775 - DNA, 298 bp, Halyomorpha halys
gtgtagttgatgcccttggaaaccccatcgatggaaagggtccattaaataccaagaaaagggctcgtgttggaataaaggctcctggtattattcctagaatatctgtcagggagcctatgcaaactggtatcaaggctgttgattcattggtacctattggaagaggacagcgagaactcattattggtgacaggcaaactggaaaaacagctttggctattgataccattattaatcaaaagcgtttcaatgatgcagatgaggaaaagaagaagttgtactgtatttatgttgc

SEQ ID NO: 776 - DNA, 216 bp, Halyomorpha halys
gtatttatgttgctattggccagaaacgatcaacagtagctcaaatactcaagcgtctcaccgatactggtgctatgaaatacactattatcgtatcagctactgcctctgatgctgctcctctgcagtatttagctccttattctggctgtgctatgggagagtttttcagggacaatggaaagcatgccctcatcatttatgatgatttatcca

SEQ ID NO: 777 - DNA, 354 bp, Halyomorpha halys
tatccaaacaagctgttgcatacagacagatgtccttgttgttgaggagacctcctggcagagaagcttatccaggtgatgtattttatcttcattctcgattattggaacgtgccgctaaaatgaatgatacacatggaggtggttctcttactgctttgcctgttattgaaactcaggctggtgacgtctctgcatacattccaaccaatgtaatttctattactgatggacaaatctttcttgagactgagttgttttacaaaggtattaggcctgctatcaacgtaggtttatctgtatctcgtgtaggatctgctgcccagacaaaagcaatgaaacaggttgctggtt

SEQ ID NO: 778 - DNA, 224 bp, Halyomorpha halys
tggctattgaagaacaagtagctgttatctattgtggagttagaggttatctggacaaacttgaccccgcaaagatcacatcttttgaaaaagacttccttgcccacatcaggacctcccacaaagatctccttgcaacaattgctaaggaaggaaagatttctgatgatgtcgatggtaagctgaaaactatcgtcacttcatttttggcctctttctcagga

SEQ ID NO: 779 - DNA, 777 bp, Halyomorpha halys
aaaagattgttttatatgcaaaaaaagtaggctattcacctgactacattttcctgctccgaaatgtgatgcgtgttaatccagatcaaggtgttagctttgctcaaatgcttgttcaagatgaagaaccacttgctgatataaatcaggtttatcaaggaaaatacacttgtgcatggattgttgacatactgatggagcaaaatatggtacaacagtgcacagctttccttttggatgcccttaaaaataatcgaccttcagaaggccctttacaaactaggcttcttgaaatgaatttgatttctgctcctcaggttgctgatgcaattcttgggaaccaaatgtttacacattatgatagagcccacattgcacagctttgtgagaaggctggtctactccagagagcattagaacattatacagatctttatgatataaaacgagctgttgttcacactcatcttcttggccctgattggcttgtgggatactttggtaccctttctgttgaagattctcttgagtgtctaaaagccatgttaactgcaaatattcgacagaatttgaatatatgtgttcagattgcaactaagtaccacgaacagctgacaaccaaggctttaatagacctttttgaatcattcaaaagttatgaggggttgttttatttccttggctccatagttaatttcagtcaagatcaggaagttcattttaaatacatccaggcagcctgtaaaacaggacagataaaagaagttgaacgaattt

SEQ ID NO: 780 - DNA, 466 bp, Halyomorpha halys
agaagttgaacgaatttgtcgtgaatcgaattgttataatccagaaagagtgaaaaattttttgaaggaagcaaagttgacagatcaattaccacttattattgtttgtgatcggtttgatttttgtcatgatttggttttatatttatacagaaacaatttgcaaaaatatattgaaatttatgtgcaaaaggttaatccatctcggttgccagttgtaataggaggattattagatgttgattgctctgaagacattattaaaaatttgatgatggttgtaagaggacagttttcaactgaggagcttgttgctgaagtagaaaagcgaaatcgactgaaacttctgcttccttggttggaaactcgtgttcatgaaggttgtgttgaacctgctactcataacgctctagcaaagatatatattgatagtaataacaatccagaacgattcttgagtcctttt

SEQ ID NO: 781 - DNA, 640 bp, Halyomorpha halys
atgggtcgagtcattagaactcagagaaagggtgcggggagcgtatttagatcccacaccaaacaccggaaaggtgccccaaaattgaggtccttagattttgctgagaggcatggttacatcaaaggtgttgtgaaagacatcatccatgaccctggcaggggagctccattagctgttgtgcatttcagagatccttacaggtttaagacccgcaaagagcttttcattgcccctgaaggaatatacacaggtcaattcctgtattgcggaaagaaagccaacctacatgttggaaatgttatgcccgttggtactatgcctgaaggtaccattatctgtaacttggaagagaagactggagataggggtcgtctagctaggacttcaggaaattatgccattgtaattgcacataatcctgactcaagaaggaccagggtcaagctcccatcgggcgctaaaaaagttattccctccaacaacagggccatggttggtattgtcgctggaggcggtcgtattgacaagccagtccttaaggctggtcgtgcctattataaatacaaggccaagaggaactgctggcctaaggttagaggtgttgccatgaacccagtcgagcatcctcacggtggtg

SEQ ID NO: 782 - DNA, 805 bp, Halyomorpha halys
atgatgactgaacaatacaaaactttgtttgccgcagttgaacatggacacctggagaaagccaaaaccattttggaatcgaccgatgtggatgttaatggagttaacagtgatggattgtcacctcttgatgtcgctgttctcagcaacaatcgctcactcgctaaaatgctcattgcatttggtgctcaagaaggcaacgaattttcaagtggtgaaagtttgctgtgccatttgaaaaatttgaactgtgaggcgaatcagcgaatatgtgaactctctggtcaagatgcccgaaaccatggactatggcaacgcagggccaaagggattggaaacatgatctcgggttttacacaagcaagaccacctgatattccatcactcgtggctgtggatgtcactgggagtcattctgttaacgtacgttaccaagaaccagacagttctgattcacctgtctgtaccaaatataaaattgaatggagcactgagagtgaattccgaaacctagctggttttcgagtgatattggacccaaggcaacaagaatgtcagatagatgatcttacacatggtcagaaatattattttagggtaagctgtggcaatattcgtggctggggtcatccgagacctgctacgcctcaatctgtcataccatcaagctggagggatgttgtaaaaagggaagacagggtctgcacagagggactggctcaattggataaattgtttagtgaagtgcgaacaggaaggcctgacatcaaagcccttcaagagacctcagccggcgaaaggagaa

SEQ ID NO: 783 - DNA, 2044 bp, Halyomorpha halys
agccggcgaaaggagaaagaaaactacaatcaagcaattgttcacagctgcctctaagttccaaaaacaccttagaagaggtgtatatctttcttgtttgttatataatgaagataaagtattactaaccaacgaagacttccttccagtcatagaagttgatgagacttatcctggttccatttaccatgactttcattggttgttgaagattgcatgtacatgggatgatgttaaatggttgaggcaagatatggagaaatctttaagttctcctggagtacactttagaataaagttgctgcaagcagccactgcgatgcaaactgctttaagcgtccaggatctgggacagctatatcataagccattgagagactctgaaggcactattgtaatatgtactgtaaactatgtgagatcaccaaaatcagtatctgtcctcaattctcggtggattccactcggcaaactcaataagaggacgcacaatattgcaacagaagcaactctgagtgatattctaatggcttctattcctgaccaaattacctaccatcaggtgagtagtataaagcttccacgtggattatacctcggctatttgaaaatgaggagttgtgtcgacgttttacaggttttggtgccggctaaagcaccaaatgttcctccgcattgcaaaataagggataaccctcatattactgcagaagagtgggaaagcttaacagttcattatgatatgggcgataaatcacagaccgaacagcagaaaacgtttgttgagcaggtcgcagcaactgtgaataggttgctgacgtatatgcaagtgtccagtgatcaggctcagaaccatagattatacgatgctgaagttgtcgaagtaagtactgacgtcagcctactaattgtagctcctcctccagaatcagcctgctcagcacctggccaaggagagattctcttacaacgacctgatctcattcctcttcctgtccaggtttttgaaatggtgcatttagggacataccacaaacaactagtcgctcggtattcaagattaagctgtataattgaactggatactgcattagcccagcacagccatcgggaggccttctctagttctgaagttagtgcggcaaaggaaagactaacaaggctagaaggactccaagctcagataaatgctgcttggaaacaggcaagatggctcttggatgttctagcttttgctagagataaaggcagtcaaacaccaactaacattattaggcatttactttcacttcatccaaagaggtcacatgacagcataggatctcacaatggcttgctcttaccacccgatacaacaaaggcagtaaagtctagaggatcttggccaggacctggtgtcagcagactgttaggagcagcgacaacagaattatcaagaagtgagcatcaactaagctgttctggaaccagtacaccaccaccaatcttgcgattgccaccgcccaaacctctctcacctccagcactcttattagagcaacctagattgccgccttctaaatcagaggacactttagctttgcacacaagggttatggctgcacattcgaggaatcggacaagtacctctgctactacttcgcccctcctctctatacgaccggggtatggaagtggaagtctttattcactgtcctcagatgactctggggtatatgcagcttacgagacgggacttgctgcagggacaagccttaagatccatgttagccctcggacaactgcaagggaagtcgttgacctagttgttaagcagctcaacatggccgtggtcctaaaagggaaggaagggcctatctactcttccgaacagctgcctaacttctgccttgttgcggtcatcggtgcaagggagcgctgccttcgagatgacttcaaacctctccagctacaaaacccctggaagaaagggcgcttgtatgtgaggcagaagcatgatgtccttgccgctctagagcagagttcaaggcactcggcctactta

SEQ ID NO: 784 - DNA, 322 bp, Halyomorpha halys
atgcatcttccgggtggaacgggagaactctggggggagatgtacgggggactctgttctgccttgagcgagcatcacggggagcttatacagacgggatctccaagcattctctgttcggcgctgcctaatcattggagatcgaacaagtccttaccttcggcgttcaaagtcatagctttggacgatgttcctgacggtacgatggttacagtaaaggccggaaacgacgagaactactgcgccgaactgcggaacggctcggctgttatgaagaatcaagtggcgaagtttaatgatcttaggttcgtcggaagaagtg

SEQ ID NO: 785 - DNA, 320 bp, Halyomorpha halys
ggttcgtcggaagaagtggcagggttattttaataaatggtgataataatgtgacaagaataataaatagcaatatggcacttataggtaaaagcttctctttgactatcgtcattggttcttctcctcaccagatggcagtatactccaaagccattaaagtcaccgtagatggtcctcgtgaaccaagatctaagtcaagtttccattacatggcctctactggtagcccattgactctgggcggtttttctctactaccccctggctggctggacgcagcttacctcagtgcctactggcccgagtacatgaggagg

SEQ ID NO: 786 - DNA, 441 bp, Halyomorpha halys
atgaaaatgaacaagttagtgacctcttcaaggaggaaaaatcgtaaacgtcattttacagcaccatctcacatcagaaggaaattgatgtctgcgcctctctccaaggaactcagacaaaagtataatgttcgtaccatgcctgtcagaaaagatgatgaagttcaagttgttaggggacattacaaaggacaacaggtaggcaaagttattcaggtctacaggaaaaagtttgttatatatatcgaaagaattcaaagagaaaaagctaacggtgcaagtgtgtatgttggcatccatccttccaaaacagtcattgtgaaattaaaaattgataaagataggaaagaaattttggatagaagatcaagaggaagagctctagcccttggaaaggacaaaggaaagtacactgatgagaacacagcaatggatacatct

SEQ ID NO: 787 - DNA, 374 bp, Halyomorpha halys
aacgtgaaaaagaagaaaatgaaccagaatataaatttgagtggcagagaaaatataatgctcctagagaagattactgcaaaggaaatgctgaaattcaggaccagccttttggaatccttgtaagaaatgttagatgtatcaaatgccgtaaatggggtcacattaatacagatggccaggtagggattaaaatgaggaattctgaggttctccaggcttccttagagctttctctgcacctcagttggagagggccacaccagtcctcgacagcttggaaaaaagcttgcaagtttagagaatgtctgaaatcccaaacttattttccaaatttaggccaaatcaaaatgtatgtatgtattgtacttgtt

SEQ ID NO: 788 - DNA, 341 bp, Halyomorpha halys
aaaatgcgaaacataaaccaggaggaggcaacataaaaattgaacataggaaactaaatttcaatgttgcaccaaaaattgaggcaaagaatgatacttacactccaggaggaggtgacaagaagatacaacaggtaaaacttcaatggaatgcgaaaccaaaagttggttcacttgacaatgctgcccataaacctggtggaggagataaaaaaatagaatcagtaaaattagatttcaaagagaaagccaaacctaaggttgggtcaaaggacaacataaagcatgttgctggaggcggaacagtgaaggtaaagtatacatttgatattcaccatatt

SEQ ID NO: 789 - DNA, 236 bp, Halyomorpha halys
tacatctcctttcttgggcgtattacctcctggaaagtcaattcaagctcttgaaaacaacatgtacagagcaccaatatacgaacacaaaataccaacttcagattttcttataattagaactaggcagcagtactatattcgtgagattgattctttattcgtgactggtcagctttgccctctttacgaagttcccggccctaactcgaagagggctaataattttgtgagag

SEQ ID NO: 790 - DNA, 698 bp, Halyomorpha halys
ataattttgtgagagatttccttcaggagttgttaaataagtttaagttagttttcatttatcgtctcttttggaaaagtaacgatacacctagacggataaggatggatgacattaaaaaggcttttccatcacactctgaaagtagcattagaaaaagactgaaattatgtgccgatttcaaaagaacaggtatggattcgaattggtgggtaataaagccagattttaggctaccgaccgaagaagaaattcgtgctatggtttcacccgaacagtgttgtgcttatttcagtatgatatcagctgaacagaggcttaaggatgcaggttatggtgaaaagtttattttcactcagcaagatgacgacgatgaagatttacaactcaagatggatgatgaagttaaagttgctccttggaatactactagggcttatattcaagccatgaaagggaaatgccttctgcagctcacaggaccagctgatccaacaggctgtggtgaaggtttttcttatgtcaggatgcccaataaaccagctctcagtaaagaggaacaggaagcccaaccaaaaaggaccgttactggaacggatgccgatcttaggagactttctttgaacaacgctaaagctctgctgaggaagttcggtgtgccagaagaagaggtatttctaataaaaccatttaatttt

SEQ ID NO: 791 - DNA, 1047 bp, Halyomorpha halys
atggaactagcagtgggaaatacagaaataatgaaaaacatcgtcgctaaaggaatacaaacagaaatgggaactccctacaattcaggttcaggttatgtgacagaaaaactttacatgttacttcaactttatttacaaaataaaggctggaatcatgattttcttcaatgtttttctgaattaaaggatccttcaatgttgccaagtgcagcttatttacagatgatggcatctcgtataacacttgattctcaaggtagattaatacttagggagaatggaaagataattttgccatttgaacatttcgcaaatgctgtaatgctcaaacatatgaatggtccacacggccttcatttaggtcttgaagctaccctccgaactgttatggagtcatatacaatgggaagggaaaattttgggatggaaaaggaatttgtaattgaagtagtgaataactgtccaaacccagcttgtcgttactataaaacacagttggatctctctcacaataagcctacatatatcccagaacctaccatgttgaaagccaatttgggagagagcagcagtagtgatatagacagggtgaaaggcacgcctattcctgcttcgcagaatcaacacaagctaacagactttctcaagtcaagtctcgacaatctagacagcctcacaagtgctaataaagacctcctagctgttcataacggtgcatggtccagccatgaggctactgaaagtaaaaggcattctgcatcatctagcagtgaagttgggcaagagaaaatagtacgggcctttggagaaattatgaaaaatatgagcaggatgaaaacttgtatacgaccagccatgtgtaaaccttacggaaaacaatcggaatctttacaaaaaacgctgatggatacaatacagttggttcagtcattacgatcaattctgccccctccacatattgctgtcagtagttggaagaatgaagacaaacatagtgtgtcaagagaggcctattctcaagagtttgcgacaatggatagaatg

SEQ ID NO: 792 - DNA, 455 bp, Halyomorpha halys
aggagttcgacaagagtcactacccctgcgtctcgacgagggagaggctggctgccaagacctgtctgtcagaagccagggtacaggtatggttctcaaatcgtcgcgcgaagtggcggcgacaccagcgcatgaacgctctcaagtcgcaggctgctggaggcggcggtggcgactggaggacgatgggtggcgagaactccgccttcaaggctccggacaggatgtcggacacctctgaggagatcaacgtcacggattccgaagaggagtcccgccagggttcggaggttgcggtaccgcttcatcgccactccccgccacagcagcaggagcaagagcttcctcgactggcgcctccagcggacctcagggcctccatcgagagctggagggaatcggccctcagggcggagcctctccagctcaccaagtacgacagggatcgtgccctc

SEQ ID NO: 793 - DNA, 586 bp, Halyomorpha halys
atgagcagtagtcaccgtacctacagaaggacttgcaacaacaacgttaatgttgataagactagcagtacaagtgctggtattttcaatgagtgtgatgaaagtcgcactagtttttctgcaattggctgcagattgacattaccctccatcagccccaggacatcttataatagaaccaaatttcctaaagacattatctgtaacagtggtttcccatcacctagagattcaccaagaactgtaaaaagcagaactcgaccgactacgaaaacgggttcgactataggacaagctgcttctaaggtgccgctgcccaaggtgtttggtagagggaggcgtgcagaagaaatatcacctcccggtaagccagtaccttccaacgacaccaataccaatgaaaataaatcagctcctagagttgtagtaggtctgccacctaccaaagaggctttaaagctccaggcagagacatcctctgtcttccccgccaaagatgatcaaggccctgttcttacccctgaggcagaattacctggagaaattccacccagccaagcacaggaagatgatgaagaaaaagcta

SEQ ID NO: 794 - DNA, 219 bp, Halyomorpha halys
atgatgaagaaaaagctattggggtatctcctgatggcaggtttcttaaatttgaagaagaaataggaaggggtagttttaaaacagtttacaaaggtttggatacagaaaccggtgtggctgttgcatggtgtgaattacaggagaaaaagctcaataaaaatgaacgacaaagatttagagaagaagccgaaatgttaaaaggattacaacatccaa

SEQ ID NO: 795 - DNA, 4436 bp, Halyomorpha halys
tgtgtatgctggaaatggctacatcagaatatccctattcggaatgttcaggtcctgcccaaatttataaaaaagttattagtggcataaaacctcaaagcttcgaaaaagtagaaaacccagaagtgagagaaattattgagcaatgcataaggctgaaaagggaagaaagacctggcataaaagaactgttgaaccatgtgttttttgctgatgatattggtttgaagttagaacttgtatcaagagaagaagcaaaaagtggtataataagtgatgaagattcgcgttctgtggaaaagatgttgatagctcagatcatttcattgaagaaagctagagaggatcgtaaactccttgctgaacatacatttgaggatgagttacatcttgccacacaagttgaatctcatagtcagataaatccaggttttggagacatcacaaatagtcaacaaccagtatatggtcaattaggaacagaatatgtgcctacttacagctcagatatgtatgggcaggctgataagtatgtacaggattcaatgatagttacatcaatgcagtgccagcctatacaacatcctgatgtaagtcaaggttatcaagaaccatctcaggatatacactttgctttatcccaagcacaaccttctcagatgcattttcctgtatatgacactatggctactgataatatgcaacatagaatatctacaaatgttcctccacaagttagtgaaaatatgcaacaaatgctttctcaggtacatcctcatggaggactgcttcaagacaatcttcaaaatattccatcaaacattccacaacatccaattcagtcagacaatttgctacaacagccacagattcagcagacagaaatgcaacatcgcatatctcacatacagtcacctaatattcaagttgaggtatccagaatttcatctactgcacctccatttgaatcgattacagatagccaaggaagaattcagttacagccatatgatcattccttaagtggtgagcagccgcaccaggttacatcctctcaaagtgcacagtatcaagcatcgaactatgatccttcacacattcaaacacaccagcttcatccctcacagcaaattagttctcaaccaatccaaagccagaatgtggatcaattttcccagtccgatttgcagccaggtatggcacaaaatcagactcatgctcaacaaaatcagcattatgatacacaaatgcagagtgattctcatagattatctcaaattcattcaccgtatgttccgcaatacgaaaatcaaaatactgatattcaacatagagtatctcaagtgcaacctcccttagtacaactcactaattatgatttgaatcaacagccaccagagatacgtgtttcacaaatccagccccctcaaatgcaatcttctcaacagagcgacttggggcatagaatttctcaagttgttcctccacatattcagcaatatgaccctcaaggtaaaatagagggtcagcagcaatctgtatcacaagttcttcctaccaatgttacccagcaacaacaatttgaactacaccagtcaccgacagatattcaacatcaaaggatttcacatgggatacaaccaacattgcaacaggctcctcactatgatactcaggcagacttcagtagagttcctcaaatcagccataatcaggtttatgaatctttgtcccaaaatgaattaccttctgtttcacaaatttcttcctcccaaattaataccaccctttacgaatcatctcaacaaggagatattcaacatagagtttctcaagttaatcctccacaatattccactttgcattgtgattcttatcaacatacagatcaaagaaatgctcagatgttgatttcgcaaaattctcaaaatcaacaatttgatcaacaacatgagtcatatcgggtctctcagattattccaccaatgcagcattatgattcaggtaatcaaaggatttcgcaaagtttagcttcaaatatgcctcaacaatatgaaattacacaacagcctgatttgcagacaagagtttcaaaacattctgtttcccctgtggtacaacattatgaaaggcagattacaggggatagtccaattccatcacactcgatgactctttccaatactgcactatctcagacacactcagaatctcagccacagtttacatcttatcaacaagatgaaataagaacttcacagtatgattcgcaagtgcaacatcagccagtgcagcaatctcagtatgaatcacaaattcaccaagataccaaccaaagaggacagcaacctcaacaatttgaaacacatatacctagtgatataaatcaggtttctaacaaccaaccatttgaacaagctcatcctcagcaatatgattcattgaagcaggttgagaatatagtgactcagatccccaatgcacaaagtcagaaccaggtttatgaaatgaaaagtcagactgatgttactcataggatatctcaggttgttcctccatctttgcctggttatgatcagctccattcagatatttccaatttttcgcaatctcagaatcaaccaccttctagatatgaacatcaacaaacagatcttcctcatgttctttctccaaacccgcctcattatgaaagtaatcaatctataaatattcatagaatatcacaagatcaatctccttgtttgattcctcatcaagaatctcaaaaccaaattgaaagtcagaggatatctcaagtgcaacacactcatcctctcacccaagcaccatatgatccacagatgcacagtgatcgagtttcacaggttcaagctcctaatattcaccaaacagcccaaaccgttctgtctgaaagctctcctagccagccagttccctctatacaacagttacagtttactcaacctcaactatcagatggtttggtccattctaacttatcatatgatcatactcaaactcaaaatgagcctatgatggctgcctcccaaaaaccacagttcataacccaaccaagttgtgaccaaatggtattatctagtcaaccttcccaggttcaacatgaattagatcaaaggaagtatgaaatacctcaacatgtccctctagttcaaataattcagcagccttgtcattcatcacaacaatcagaccctcgattgtctacagttgaagcacccattattcaccaaactcacggtgatttaaatcttccaatgcctgtgttacactcccaagggaatcaaattggttcagagttatcaaatcagagccatactccacaaaatgtgctctctactgaaactcaccaattaccttcaacattaaatcaatatgatcacatatccaacattcctttatctcaaaatgaagttgttcaaaaaaatgatatccctcaacgaagccagagctttacttcaactactgagcctcctacgcagatacaactggacagccttcacaggatgtcagtagttaatcctccgcagttaaaccagaattaccaaataaatgttgagaatttacaggcatttaatgtgattccacagacccaatttgtttatgataatgctcaaactgataacttaccgcaaatggctactagtgatcaatcaaaatacaatgtagcacctttgatccagcctaatgttcagttgccatgttaccaaacacagcaaaatgcatgtaataaatgcctacaatttccatgcaatcatacaattgtacaggcaaatatttctccagatgaaaaaggtaacgtgttacagtcccacacacctgttatacaaaaaagtgaaataacattacccgatggtattgagcaaccatctcagtttcttccccagcaaacaactggaataacatatgatcagaataccaatctagtcagtattaataatatgcctcagttggtcaccaaccaggtctctggtttggcatctaatgaccacaatatggcaggcattcaaaataatcaagatatgcctctgtctcatccaactgttcctagtttgcatatccctcaattaacatcacaacacacgaatgagttgactagaaatcctgtccaggattccaattatgtggaatctactttgccatctaaccaatttcatttgaatgatgcctcaaccccattaaatacagatgttggaatagctcagaatgttggtcagtttttaggaaggcaggtttctgttgagcatgatttggtgcttcctcaggctcctttatctcatagtgaatcaacaaatgagatgctaagcccaccgactcaattgcagttgtctcacagttcgccagctcttggatcagattctcagatttctcaggtatttaaatattttcttgaagtgagtgtgagaatggttgta

SEQ ID NO: 796 - DNA, 607 bp, Halyomorpha halys
atggtacttgacactgtcataaagctattcaattctggtggccatgaaaagcttggtgtcccttgtgtgccccctttaactcagtcggttgctgccagagcaacaactaaagaagagaagtatgaggcattcagagctaggatgttggccaagaggagaagagcggaaatgtattctctgtggtgtgacgctttgtacaggttatcattagctaatcatttcagggatcgaatattttggttgccgcacaatatggattttcgaggaagagtttatccatgcccaccccatttaaaccacttggggtccgacctgtatagagctcttttggtttttgcgcaatcccgacctctaggacccgaagggttgaattggttaaagatccatgctatcaatttaaccggtttaaaaaaaaaagaatctgttcgctgtaggttagattatgctaatgaaattcttccaaagattctcgattctgctaaggagccgttcaagaaaggagcttggtggatggagagtgagaaaccttggcaaacattagctacttgttttgaaatacgcaatgctttgaaccatagaggaggacctgaaagctatccttgttctt

SEQ ID NO: 797 - DNA, 429 bp, Halyomorpha halys
aaagctatccttgttctttcccagtacatcaagacggctcctgcaatggtctccagcactatgcagcgctcggtagggatacttcaggagcagaatctgttaatctctctccatctgatgtaccccaggatgtttattcatgtgttgcagctattgtcgatagagaacgagcaaaggatgctcaaaatggagtcgaaattgctcaacatcttgatggattcattcgaaggaaagtaatcaagcagacagtgatgactactgtatatggagtgacacggtttggggcaaggttacaaattgcaaaacagttgaaggatcttgaagattttccgaaagaacatgtctggcagggatctcactatttagttcataaaactttctacagtattgcagaaatgttcacttcgacgagagaaattcaagattggt

SEQ ID NO: 798 - DNA, 363 bp, Halyomorpha halys
ttggcaactactgatagtagactatcaacccttcaacttccctcgggtattggcgtcggtcaggttactgccaatcctgtccagggtactaaggaatggcatcaatctgttaccccggacctccgcaaccatcttgtgcataaacttgtccaagcaatatttcctactcctgatcctcaggcaatgttggataagaggatgcataaccttgttgcttatgcgagaaaagttgaaggtgatatgtatgaaatggcgaattcaaggtctgagtattatcatcttttggctgagaagatttacaaaattcaaaaggaattagaggagaaacgacagaagagaaaagaacagcagcaattgcagcag

SEQ ID NO: 799 - DNA, 674 bp, Halyomorpha halys
caacagcagcaggttcagacgcaggctcaagtacaagcccagactcaagcggcggtagttcagaggacacgggggatggtaactggtgccgtacccgttgcagttgttcctccgcggcaagatccttctcaacctctccattctcagtcaccaggaataggtattggaggtaacaggatagggtcccaaatgggtccgagtcctagcggtcctgcttcgcagcaaagcgtgactggactctctccatttgctgcgaaccctccctctgttccaccaacaacaactagtcaatttcagaacactaatcatcaggccaacgctcgattaccaaacactgcccaaacctcacctgcttttggcctacatccgtttccttcacctcagcaagtctccgcccctgcaagtcagtctaacagcgggagagtgccatctcctccatcatcaccaatggcgagtccaactgttgcaccttctccatccatgggaaaattttccaaccatactccgccttctactcttgctcgaactcaacaatctagtagtaattcatattcaagtcagatggccgctatcactgcttctctcgccagagatgaagattcacctacttcaaataacaaccaaacaagtagaggtaaaggagatattaaactggagcaagatgaaatgaaaga

SEQ ID NO: 800 - DNA, 1232 bp, Halyomorpha halys
gcaagatgaaatgaaagaagatgaagaagctgagagaggaagcggaaaaggaataggcactggaaaaataaaacaagagcctatggatgatatgcctgctaaagatgaaatcaaagaagaacctaagtcacctaaagttaacgacactcctgatgtaaaaccaactgttgtacctgaaccaatacagcagggtgtcggggttgacaagaagaaaaaatgtttatttaagcctgatgacctgaggcaagcattgatgcccacattagaaaaactgtatagacaagatgaatcgttaccttttaggcagcctgtagatcctcaatcccttggtattcctgattattttgacatcgtaaggactccaatggatttgtcaacagtgaagagaaaactcgatactgggcaatactcggatccgtgggaatatgttgacgatgtttggttaatgtttgataatgcttggctgtacaatagaaaaacctctcgtgtgtatagatattgtacaaagttatcggaggttttcgaacaagagattgatcctgtaatgcaagccctgggttattgctgtggtaggaaatacaccttcaaccctcaagtcctctgttgctatggaaaacaactgtgcactattccaagagatgcaaaatattacagctaccaaaatagaggatatggtgtttcctgtgatagatatacctactgccacaagtgcttcaatgacatccctggggacactgtttcgcttggagatgatccttcccagccaccaactgtgataaagaaagatcagttcaaagaaatgaaaaatgatcatttggaacttgaacctttcgttgaatgtaccgactgtggaaggaaacttcatcaaatttgtgtcttgcacatggaaaatatttggcctcaaggctttacttgtgataactgtttaaagaagaaatcagccaaacggaaagataacaaattcaatgctaagaggttaccaacaacaaaactgggtacatatattgaaacgagggtcaacaattatttgaaaaagaaggaagcaggcgctggtgaagtggccatcagggtagtcgcgagctcagataagattgtcgaagtaaagcctggcatgaaaaataaatttgttgaaaatggagatctacctgatcagttcccttatcgggcaaaagccctttttgcttttgaggatatagatggaaccgatgtatgtttctttggcatgcacgttc

SEQ ID NO: 801 - DNA, 243 bp, Halyomorpha halys
ttggcatgcacgttcaggaatatggatcagaatgcccaacacctaatacgaggcgggtttacatagcctatcttgactccgtccacttctttaggccgaagcagtatagaactgctgtctatcatgaaatcctattaggctatttagactatgtgaaacaactaggatatacaatggcacatatttgggcttgtcctccatcagaaggtgatgattatatattccactgccatcctcaagaac

SEQ ID NO: 802 - DNA, 507 bp, Halyomorpha halys
agtatttttcgttattaggctacattctgctcaaagtgctgccagcttagcgccaattcaagatccagatcctttcattaattgcgacctaatggatggccgtgatgctttcttgacgatggctcgagaaaggcattatgaattttcttcattacgaagagcaaaattttcatcaatggctatgttgtatgagctccataatcaagggcaagataaatttgtctacacttgtaataattgtaaagcccatgtggaaactcgttatcactgtacagtatgtgatgattttgatttatgcgtgacttgctttgaaaaagatgggcatcctcacaaaatggaaaaacttggtttagatattgatgatggttcatcacctgcggatcagaaacaagccaatccacaggaggctaggaagttatccatccagcgttgcattcagtcattggttcatgcttgtcaatgcagggatgccaactgtaggttaccaagctgccagaggatgaagcg

SEQ ID NO: 803 - DNA, 267 bp, Halyomorpha halys
ctgccagaggatgaagcgggttgtccagcacactaaagtttgccagaggaaggcaaatggcaattgccctatttgcaagcagctcatagctctctgttgttaccacgcgaagtattgtcaagaaacaaagtgtccagtgcctttctgtttgaatatcaagcataagatgaagcaacaacagttacaacaacgtctgcaacaagcccagctacttaggagacgtatggccgtcatgaatacaacaagaggtggaggaggcggtggggg

SEQ ID NO: 804 - DNA, 586 bp, Halyomorpha halys
tggaggaggcggtgggggtgggggtctaagcgggggggccgtgagccctggtggagctggaccccctgccctcatggccccccagcctactcatcagtccctcggcctcaagcctggttctcagacccctcctgccaacgttctacaggttgtcaaacaggttcaggaggaagcagcgaggcagcaagcgccacaggcggccctcggttacccaggaaaagttgctcctcaacagcaagttatgccgccccctggccagcgagggggtatccagcaggtgcctggcccgcctctcattcctcccattgaacaatggacaccgaggtatcagaaccaggtagggatgccagcgacagccgggcaaagacctggaatgttgcccggaggtgggagtgcgatgccacctagtgctgctgccgtacctgctatgcgggggcaagctcaaacacctgccgtccagaagcaagtactgcagcagctacttcagacgttgaagaatcctactactcctgatcagcagcagcagatattgcatatattaaaaacaaatcctcaactcatggctgcgtttataaagcaaagacag

SEQ ID NO: 805 - DNA, 1042 bp, Halyomorpha halys
atgaaaattgacagctgcaatgctggtaaggagctttactctccagaagcagaaacatcccctgctccaccaaacagtgaaccagcatccaaacaaactactagagcgaattcttttgaaattgaaaatctccttaaaactgctgaacaggttacaggattctgcagatctccggttgaaaccagaaagtcaagtccgactggtagtgtggttagctcaggtgcaggacttacccccagcagacaattgacagatgctgaaaaactgaggaaagtcattcttgaattgattgacacagagagaacatatgtaaagcacctaaacagtttactagaaaattacttagagcctcttaaaaaagaaacatttctttctcaagctgaaattggtgctttgtttggaaatattcaagaaattgtttctttccaaagacagtttctgcagaatttggaagaggctcttgaaatggagccagactttcacaagtttgatcatcccagtcaattcaagaatgtattattctcagtcggaagtgcatttctgtattatgtcaaccactttaaactgtacagctctttctgtgcaagtcactctaaagctcaaaaagttcttcaccctaatgaaggtaaccaagcattgcaagaattcttggcagcgagaaatccaaggcagcagcactcttctaccctcgaatcatacctcattaaaccaattcaaaggattcttaaatatccactgttactacaacagcttagaaacttgaccgatccacagtcagaccagcatttacatttattagaggctttgaaaggaatggaaaaagtagcagaacatattaacgagatgcagagaatacatgaagaatatggtgcaatttttgaccatctttttagacagcaccaaaaatcatgcaagcagccaattgacttgagtcccggtgatctcctatattatggtggcgttgaatggttgaatatttcagatttccttggaaaaataaagaaaggcctggaactgcatgctatgtgttttgtttttaaat

SEQ ID NO: 806 - DNA, 887 bp, Halyomorpha halys
tgtgttttgtttttaaatctgcggttgtctttttatgcaaagaaagaatacgacagaagaagaaactgatgagtgttgctagtaaaggtaatccaaatgaagttgagataataagatatcaagtactgattcctgtgacggaagtacaagtgagagctagttcagctaaggatatggaatctcatttcctttgggagcttatacatctaagaagtcagctacagagaagatctgaaaaagtgtatgttctctctaacagcactggagattttagaaatgcatttttaaaaaccataaggcagattattcgtgaaagtgtgagaaacatgaatattcctgctacaaaaccaggaacacctcaagtcagtggtgcatcgactcttggaagggggcagcaacagagtcataaaggaacaatggtcgaacagccccaacctaagaccactgcctcaggtgcggttattatgcctggatcccagactctaggaaagtctaaacgacctccaaaaggcccacagcgtcattcagcaggaaatatcgactatgacggagattcaagggaatcgagtgttgaaggcgcttctcagacttttagatctcgaagtaaaactgtatctgatgcagttgatgattcatcagaaaaacatcgccatgacttagatccaggtactaagtccgaaggtgaggaagatggaggtagcaagaagtccggcctcggaaggactcctaaccacttgaccctctctactacttctactctctcagctggttcgaccggtagccaagctcgccttattcaatcctctcaacaacctcagaactaccaaccacctccagcagacctaggtaatatttgtgcacactgccaccagccgcggttgtctaaa

SEQ ID NO: 807 - DNA, 455 bp, Halyomorpha halys
gttatatggaaatatactgtgaaagggttcgtgacctgttaaatcctaaaaacaaaggtaatttacgtgtgagagaacacccactccttgggccttatgttgaagacttatctaaactcgcagttaccagttatgaagatatccacaatttaatagatgaaggaaacaaagcaagaaccgtagctgctaccaatatgaatgaaacgtccagccgatcgcatgcagttttcacaatattcttcactcagcaacgccacgacaatcttacttcattatcaaccgagaaggtcagtaagatttcactggttgacttggccggatctgagcgtgctgactcaacgggggccaaaggtaccaggctaaaagagggtgctaacatcaacaagagtttgactactctcggcaaagttatatccgcccttgctgaaatagcgactaagaaaaaaaaaaaagaa

SEQ ID NO: 808 - DNA, 307 bp, Halyomorpha halys
aaaaaaaaaagaaaatttcataccatatcgtgactctgttctcacttggcttttaagagaaaatcttggtggaaattccaaaactgctatgatagcagccataagtcctgcagatatcaactacgatgaaactttatctacattaagatatgctgacagagcaaaacagattatgtgcaaagctgttgtcaacgaagacgcaaatgccaaacttatccgagagcttaaagaagagatacagaggttgagggatctcttgaaggcagaaggcattgaagttcaagaagtgttaacttttttattatta

SEQ ID NO: 809 - DNA, 813 bp, Halyomorpha halys
atggcagctatacccaacgaatatctttctaaagcagaagatattgctgaggaggtttataaaaggacaaaaggagttttaccaactgttgctcgaatgtgcctcatctcaacctttcttgaagatggaattaggatgtgggtacaatggtctgagcagagggaatacatggacatgtcatggggttgtgggcaatttttagccacaatgtttgttttagtgaacttagtgggacaattggggggttgtgttatggttctaatacaaaagaaagtcactatagctgtcggagtactgttttttattgtaatattacagacattagcatacagtatactatgggattttcaattcctgttgaggaatcttgcactgatcggtgccctccttttcgtgctagctgattcacgcaaagaagctcggagtctgttcgctggagttcccactctagatgacaacaatcctaagagttatttgcaattgtttgggagaattctactcgcatttatgtttatcactctggttagaattgaattttcattccttcaaattgtacaagatataataggaactattatgattatcttggtcactattggatacaaaactaaactctgtgcttttgttttggtcttggtgttatctctgttgaatttatatcacaatgcatggtggcaaatacccgaatataaacccttaagagactttttgaaatatgatttcttccagacattatcagtaatcggtggcctacttatgattgttattcttggacccggaggcgtatccatggatgaacacaagaagaaatgg

SEQ ID NO: 810 - DNA, 214 bp, Halyomorpha halys
atgtctggtttctttaaattttccaggccgagcatgtcccaagggactgtcatacaccaaagacaacttgaaaaggatttcaccgtagctacacccgaagagtttgttaggaggttcaaggggaccaaggttatcaacaaggtattaattgcaaacaatggcattgctgctgttaaatgtatgcggtctatcaggaggtggtcttatgaaatgt

SEQ ID NO: 811 - DNA, 687 bp, Halyomorpha halys
gtggtcttatgaaatgtttaagaatgaaagagcaattcgattcgtggtcatggtcaccccggaagacttgaaagctaatgctgaatatattaaaatggccgatcattatgttcctgttcctggaggaacaaataataataattatgccaatgttgaacttatagttgatattgctctgcgtactcaggttcaagctgtatgggcaggttggggccatgcctctgaaaatccaaaattaccagaattactgcacaaaaataatattgcttttattgggcctcctgaaaaagcgatgtgggctctcggtgataagattgcttccagtattgttgctcaaacagctgacatcccaactctcccttggtctggttcaggtaaaattgagctgaaagcccattattctggcaagaaaataaaaatcagcacagacttatataaaaagggatgtgtgcaaactgctgaagagggtcttcagtcagcttatcgaatagggttcccagtaatgataaaggcatcagaaggaggtggtggaaaaggtattcgtaaagcagagacagctgatgattttcctaatctgtttcgacaagtgcaagctgaggtcccagggtctcctatttttattatgaagcttgctacatgtgctcggcatcttgaagtacagttacttgctgaccaatatggtaatgc

SEQ ID NO: 812 - DNA, 458 bp, Halyomorpha halys
tgaccaatatggtaatgcaatatctctttttggaagggattgttctattcaaagaaggcatcaaaagatcattgaagaagctcctgcagccattgcgcagcctgaaatatttgaagatatggaaaaggctgctgttagattagcaaagatggttggttacgttagtgctggaactgttgaatatctttatgatattgatggatattattactttttagaattaaacccaaggctgcaagttgaacatccatgtacagaaatggtgtcagatgttaacttacctgcatcacaattacaggttgctatgggtatttcattgcataatattaaggatattagagttttgtatggagaatcaccctggggagacacaatgatagactttgatcaacctaggcataagcctcaaccatggggacatgttatagctgctagaatcactagtgaaaatcctgatg

SEQ ID NO: 813 - DNA, 1052 bp, Halyomorpha halys
aaggttttaaaccaagttctggtactgtacaagaattgaacttccggtcatcgaagaatgtatggggttatttcagtgttgctgcatctggtggcttacatgaatttgctgactcacaatttggccattgcttttcttggggtgaaaacagagagcaagctcgagaaaatctagtcattgcccttaaagagctgtcaattcgaggagattttaggacaactgttgaatatctcattacactgttggagactgacagtttccaagagaatacaatagatactcagtggttagatcttcttatatctgaaagagttcaagctgaaaaaccagatgtgttgcttggtgtaatctgtggagcacttcatattgctgataggaaagtgctggatgcattccatggcttccagcattctttggaaaggggtcaggtgcaaggtagcaacactcttgaacatggtgtcaatgtggaactaatccatgagggattcaaatacaaagtacaagctactaaatctggtcaaaactcatattttctagtcatgaatggatctttcaaagaaattgaacttcataagctttctgatggagggattttgttatctgtggatggatcaagttttacgacatatatgagagaagaggttgataggtacagaattgttattggcaatcagacttgtgtttttgaaaaagaaaatgatccttctcttctccgatctccttcagctggaaaattgctcagccttattgttgaagatggtggtcatgttggaaagggtcaagcttatgccgaaatcgaggtcatgaaaatggtcatgactttgactgcttctgagtcaggaataataacatatacaaagaggcctggagcggtcttagatgctggaactctcctgggtcacttggagttggatgatccttcacttatcaccagggcccaggattacaaaggacagtttcctgaactagatgtatcgactcctactgttggtgataaattgaatcacaagcatgcccattatcgtcagatgctggataatattttggctggt

SEQ ID NO: 814 - DNA, 1270 bp, Halyomorpha halys
atgtgttttagtcccagcgacagtaagtttgcttcttgttcagatgatggaactataaaaatctgggatttttatagatgtcaagaagaaagaacactgcgaggtcatggagctgatgtaaaatgtgttcattggcacccgcagaaagcccttattatatcgggtagcaaggataatcaacagcctgtaaaactgtgggatccaaaaagtggttcatcactcgctaccatccatgcacacaagagtactgtcatggatgtaaaatggaataacaacggaaattggtttgtcaccgctagtagagaccatttattaaaattatttgatatacgcaatgtaaatactgaagtacaagtttttcgagggcacaagaaggaagctagcagtgtagcttggcatccaattcatgaaggactgttttgcagtggtggttcagatggtgctatactcttttggcatgttggcgctgaaaaagaagttggtgctattgaacaagcccatgacagtattgtttggacattagcctggcatccgatgggccatattctctgtagtggaagtaatgaccacactagcaagttttggacgagaaacagacctggtgattcaatgagggacaaatacaatcttaatactatacctgcatccctttcaggacttgaggaaactgaaattgacgaagttcaatcagttatacctggcatgggacccgaagacaaagttgaagttaatacctcacctcttcctggtctaacccctggctcaattcctggtcttgaagatttggatttatcggcagaagacaaaggaaaaactccctctaaaaaggtgccctattctaaaccaataccaaagaactttcaagctcactggaatgatacaggaaaacttgaagatatagatgatgacagcagagatgggctggacccaatagctcttatcaatcagcttatcgaacaacagcctggtgtgaaacttgtcaaagatttagaacctgaggccttgtacatttatggaaaagttctgacagttgagcctggctcagccctggcaaaagcaatatctgaaggaggagaaaaacttatgaaatacctcaattccggagcagtgaaagaacttagagatgttattccacattatgatgacaatgctgacacattcattggtgatagtgatcctgatgacaatgatcaggagatggatattatagaggatactgagccatcattacctatcacttctagtcccagtccaattccccctatgccaa

SEQ ID NO: 815 - DNA, 270 bp, Halyomorpha halys
ttccccctatgccaatgccccctgtgaattcaggcccagctagttcggcatcagctatgaaccttccacccttgatgggtgttggtcttggatcgggtcccgggccagtgccagcaccagtatctggtccaaggatgttcaacagctcacagcacaacagttaccaacccccaggaatgatgggaggaccctacaaccagccccctcctccatcaatgcaacaaccattcgagatgtaccgagctcctccgcctccacctccacaacaac

SEQ ID NO: 816 - DNA, 1369 bp, Halyomorpha halys
atggacgaaggtactgatgctcgtgatattctagaaaataaacttcttccccttcgaagaggttatatcggtgtagtaaatagaagtcaaaaagacattgatggcaggaaggacatcaaagcagctttgggagctgaaagaaaattttttcttagtcatcaggcttatcgtcatatggctgataggttaggaactccttaccttcagagggttctaaatcagcagctcactaatcatatcagggatacacttccaggattacgagataaactccagaaacaaatgcttgccttagaaaaagatgttgaacagtacaaatacttcagacctgatgacccttctatcaaaaccaaagcaatgctgcagatgatacaacagttacagtcggattttgaaagaaccattgaagggagtggttcagcccaaatcaacactgtggagctgtctggtggtgctaagattaaccggctctttcatgagaggtttccttttgaactggtcaaaatggaattcgatgaaaaggaactccgaagggaaattgcttttgctatcagaaatattcatggtataagagttggcttatttacacctgatatggcctttgaagcaatagtcaaaaagcagattgaaaggctcaaagaaccatgtcttaaatgtgtcgacctggtcgttgctgagctttgcaatgttgttcgtatttgtactgacaaaatgaataggtaccctcgtttacgagaagagacagaaagaatcattaccacttatgtgagagaaaaggagcaaatgtgcaaaaagcagttgacgatgttagtcgactgcgaactagcttacatgaacacaaatcatgaagactttattggttttgccaatgctcagaaccagtcagaaaactctaataaagctggtcgtaaactcggtaaccaagttattagaaaaggttggatgtgcattcacaacttgggaataatgaaaggtggaagtcgtgattattggtttgttctggcatctgaaagcatttcgtggtttaaggatgaggaggaaagagaaaaaaagtatatgctacctcttgacggtctgaagttgagagacattgaacaaggcttcatgtccaggcgctttatgtttgctctatttaatcctgatggccgaaacgtttataaggacttcaagcagcttgaattaagctgtgaaactcaggacgatgttgattcgtggaaagcctcattcctcagagctggagtctatccagaaaaatccactgatgcagctaatggtgatgagggggcaagcgaaggaactgcttcgatggatcctatgcttgagaggcaggtggagaccatcagaaatcttgttgattcctacatgaaga

SEQ ID NO: 817 - DNA, 506 bp, Halyomorpha halys
ttgattcctacatgaagattgttacaaagactacccgtgatttagtaccaaagacaataatgttcttaataattaatcaggctaaagagtttattaacggagaactactagctcatctttatgcatctggtgatcagagctcaatgatggaagaaagtcaagaagaagctatgaagagagaagaaatgctgcggatgtatcaagcttgcaaagaagctttaagaataatcggtgatgtttcaatggcgacagtgtcgacacctgtacctcctcctgttaaaaatgattggctggcctcaggcatggataatcctagactttctccaccttcgccaggaggccctcgaagaggtctaccctcacaaggtagtgggggaggatcaagagccccacctccacttccagcatctaatcggcctgctccggccattccctctcgtcctggtcctggggcaccttctggaagacctgctcagggtgctttgccacctcctcttattccatcg

SEQ ID NO: 818 - DNA, 534 bp, Halyomorpha halys
atggctcaaaacatcaatccttatttcacacaaagttcaactccagttaaaacaagtgagggttcacagaacaagtcgcaagataatcatgctgttactaaaaggttgcagaaagaattgatggttctcatgatgtcaggtgaaaagggggtatcagcattccctgaaggagaaaatcttttcaaatgggtggcaaccatcaatggacctgcaggaacggtctatgaaggtcatgtttttaggctgtcagtagagttccctcattcttacccatattcacctccattggtaaggttcacctccaagtgcttccatcctaatgtggacctccaaggcaatatatgcttggatatcttgaaagagaagtggtctgccctctatgatatttcaaccatccttatttcgattcaatcacttttaggtgaacccaacaatgattcccctctgaacagtcaagctgctgagatgtggtctaaccaagaagtcttcaggaagtatttacgagcgaaccattctaatgaaaattcaaaaaat

SEQ ID NO: 819 - DNA, 320 bp, Halyomorpha halys
ttaagcactggataacaattatccaatctcgctgggaagaggtttcttcttgggctaaacagaggtctgagaagcttcatattcatcttaattctcttagagatatggatacattactagaggaactcctttcatggttagctcttagagaatctgatcttcttgaaaaagaatcaagggaccttcccaacataataccagagactgagaggctaattgttgaacatgattcttttatggaagaaactatgacccgagaggttgaagtaaattcagtcttcagagcgaagcaattaaaggaaaagaaaacaacaaaaaag

SEQ ID NO: 820 - DNA, 636 bp, Halyomorpha halys
aagaaaacaacaaaaaagacaagatgtgctagatctcgcttattgtatgagagatggcgaggtgtctggcaacagtcctgggagcgccagcgtcgacttagggatcacttagctcatttgcaggagcttgaccgcttggcaaacttttcttgggatgattggaggaaaagattcttgaagtttatgaaccataagaagtcacgtttgactgatctgttcagaaaaatggacaagaataatgatggtctcataccaagagatgattttattgatggcataataaagacaaaattcgatacatctaaattggaaatgggagcagtcgctgatatgtttgatcataactcggagggttatattgactggaaagaatttattgctgctttaaggccagattgggaagaaaggaagccagctactgaagcagaaaagattcacgatgaagttaaaaggcttgtaatgctttgtacctgcagacaaaagtttagggttttccaagttggtgaaggaaaatataggttcggtgattctcagaaacttcgcttggttaggatccttcgatcaactgtcatggtccgagttggaggtggttgggttgctcttgaggagtttctagtcaagaatgatccttgtaga

SEQ ID NO: 821 - DNA, 244 bp, Halyomorpha halys
tctgcgagctggccgcgcgactgctcttctccgcggtcgaatgggcccgcaacatacctttctttcccgagcttcaggtgaatgacggaccaagtggcgctcttgcggctggtctggtcggaactcttcgtactcaatgcctcccagtgttcgatgccgctccatgtcgcgccacttcttgctgcagcgggtctccatgcatcgccgatggctgcagacagggttgtggccttcatggaccaca

SEQ ID NO: 822 - DNA, 334 bp, Halyomorpha halys
cttcctgagccacctgttgatatccaagtggaacctggtcctcaagatggaacacttcttgtcacatggcagccaccaaatgcttcatcttcagttggtggttcgataataaccggatatgctgtttatgctgatggaaaaaaagttaccgatgttgacagcccatcagacaaattatttaaacttttaggggatcatgcactaatagatataaataaactgcttggattaaatccgaagcaagtaactgttcgaacaaagtcaagagacagtcagtcatctgacagcattccaactcaaattccaatacatatattgaaggacaaacatcaaa

SEQ ID NO: 823 - DNA, 726 bp, Halyomorpha halys
tgaaggacaaacatcaaaatgaaaagcaagaagaggaaagaaggttaagatacggatcatccattccagctcatatgcgccaccaacatagacctggtcaagtcattgagacagaagaaaatcttagtgataaggagatatatccaaataataatattagcatacctgcaatagaaatcacaaaagacacaggtagtgagggtaattatagtgaagatgattatctagatagaaggagtatgggaaggggccactatgattccagaggtagtggtatgagagctagaagccatcatgtacaacaccattccagacatcatcgccgagatgacagggaccaattttattctgaaagaggggatggcagagctgctagggaaagagaaaggccagcttatcgtggttctagagtccctcatcctggaccacaccaacagggatcaagggaaaaacgccccagatggttcgttgctctgtttgattacgaccctacaactatgtctccaaacccagatgcttgcgatgaagagttaccttttacagaaggtgacaccattaaggtatttggcgataaagatgctgatggattttactggggagaatgtcgtaaccgaaggggatttgttcctcataatatggtcatagaagtgcagggtatggacggaggtgtacagaatgtaaataaagatagaagccgagatagagacagatggggagatatttatg

SEQ ID NO: 824 - DNA, 262 bp, Halyomorpha halys
gatggggagatatttatgcaaatatgcctgtaaaaaaaatgattgcaatgtatgattatgatccacaagaactttctccaaatgtagatgctgaggtggaattgtccttccaaactggcaatgttatttatgtttatggtgaaatggatgatgatggattctatatgggtgagctggatggagtaagaggactagtaccttccaacttcctgacagaagctgagcctggtaagagaagtaccagacaaggagatcgaggcca

SEQ ID NO: 825 - DNA, 770 bp, Halyomorpha halys
atgactatgttatctcagaaactgtacccagacccggtgacttccgcgatgtccggcgtcaacatgagtccagccatgacaccgacctatagtatgaactcgatgtcctgtgtgccgatgaactcatgttccccgcagagtgcaggatttccaaccaacatgctggctcctggtggcggtgcgatggcttctatgcagatgaacggtaattctatgtcttccggtagcatgggttatactaatatgaatagtagttgcatgggcacgatcaactacaacagtggattaggcgctgtcgggaccatgcctggtccgagggttgatttggctaacgaaggaggatcacctaactcagccgcactccagcgggccagagcggacaagtcatacagacgctcctacacccacgctaaaccaccttattcatacatctctctcattacaatggctatacagaattcaccttccaaaatgctcaccttatcagaaatatatcagtttattatggatctctttcccttctacagacagaaccaacagagatggcaaaattccatccggcactcgttatccttcaatgactgtttcgtcaaggtgcctcggactccggacaaacctgggaaaggatctttctggactctacaccccgaatcaggaaatatgtttgagaacggctgctatcttaggcgacaaaagagatttaaggacgacaaaaaggaggcagcacgacaatcacataaaagtgtttcaccgcatcaccatcatcatca

SEQ ID NO: 826 - DNA, 409 bp, Halyomorpha halys
gcatcaccatcatcatcacttacaccagcacgaagataaaaaggacaagttggacaagactgagctcggcctcgggagtcaaggccctctaatgaaggaggcagatccgatggccagcctcctccacggtagtggatcggaaatttgcctccagcagcaagaagctgaattgtcggcaatggtcaatcgttgccactctcaccatctgagttctgccctcgaccactacggtcatcacctgaagcaggagtacccaccagcttcctcacacccgttttctatcactaggctcctgccgacagaaagcaaaaccgacattaagatgtacgcagacatgcagtacggatactcggactccacctactaccagagttcactctaccacagccctccaggagctgctgcttta

SEQ ID NO: 827 - DNA, 462 bp, Halyomorpha halys
atgaccaactctaagggttatcgacgaggtacccgtgacttgttttcacggggctacaggaaacatggcgtcattccactttccacatacatgaaagtctacaaagttggagacattgtttcaattaagggaaatggtgctgtgcagaagggtatgccccacaaaagttatcatgggaaaacaggacgagtttacaatgtaactcctagagcgttgggtgtgattgttaacaaaagggttcgtggaaaaatattacctaagaggttgcatgtcaaccactccaagtgccgtgaagatttcttgaagcgtgtacgagaaaatgaaaggctcaggaaagaggctaaagaaaagggtattcgagttgaattgaaaagacagcctgcccagccacgacctgctcatttgataactgtcaaggagcctccaataatgctcgctcctataccttatgaatttattgct

SEQ ID NO: 828 - DNA, 1537 bp, Halyomorpha halys
atgtctagtgctgaagtggccaacaattccatagaacctccagccaagaagcggaaaattgctacaggagagactgctccagcgaactccgtttcaaaggcattatcagccatggcgaataatggatcgcacaattcgaatcaagacattgatgagggactttactctcgccaactttacgttttagggcatgatgccatgcgacgaatggcatcttctgatgttcttatttctggtttaggaggacttggtgtagaagtagctaaaaacgtcatattaggtggtgttaaatctgttacattacatgatgacactgtttgcactatatcagatctgtcttcacaattttatttatctgaaaattctgtcggtttaaatcgtgcagaagcctcttgccagttacttgctgaacttaacaattatgttccaactagagcttacactggaccccttactgatgattttatcaaaggatttagtgttgtagttttaactaatgcttcagaagaagaaaaactaagagtttctgaaatagctcatgcatccgatgtttctttaattatagcttcaactatgggtgtatttgctcaagtattctgtgattttggccgagaattcagtgtagttgacacgaatggtgaaaatccagtttctgctatgatagcaagtatatctcgagaggaagaaggagttatcgcttgtttggatgatactagacatggcttagaagatggagattatgttacattttctgaaatccagggaatgactgaattgaatggttgtgagccaactaaaataaaagttcttgggccatacacatttagtattagtaatacttctaagtttggagaatacattcgtggtggaatcgttcaacaagttaaaatgcccaaagttttgcaatttaagtcatattcagaagctctcaagtctcctgaatttatatttactgattttgggaaatttgatcatccccaacaacttcatgtggcatttaaagctgtagaatcttataagaaagaatttggcaagttgccttcaccatgggacaacaaaaatgcttcagatttcattaactgttgtaagtctgttttatctgacttaagcttggatgttgaattgaatgagaagcttatggaacaatttgctaaaacatgttccggaaatatgaatcccattgatgcgtttattggtggtgttgttgcccaggaagtaatgaaagcttgtagtgggaagtttcatccaattttccaatggttgtattttgattctaccgaattattgccaactgaagatctaagtcccaatgactgtgcagctactaattctcgatatgatgggcaagttgccatttttggaacagaatttcagaaaactttgggtgcactgaaatatttcgttgttggtgctggagcgattggatgtgaacttcttaagaatttttcgatgatgggtgtaggagcagatggtggaaaagtaattgtaacagatatggatcttattgaaaaatctaacttaaatagacaatttttat

SEQ ID NO: 829 - DNA, 1249 bp, Halyomorpha halys
aaatagacaatttttatttagacctcatgatgttcaaaaacctaagtcagctactgcagcaaaagcaataaaaaaaatgaatccattaatgaacgtgattgctcatgaaaatcgagttgggccagaaactgagaaagtttatgatgatgccttttttgaggatttagatggtgttgcaaatgcactagataacgttgatgcaaggatatacatggatcgtcgttgtgtttattaccgtaaaccattattggaatcaggaactcttggtacaaaaggtaatacacaagttgttgtccccttccttactgaatcttacagttcttctcaagatccacctgagaaaagcattcctatatgtactttgaagaattttcctaatgcgattgaacatacccttcagtgggctagagatgttttcgaaggcttatttcgccagtctgctgaaaatgctgctctttacttaagtgatgctaattttattgatagaactttgcgtttgcctggggtccaaccaatggaagttttggaatctatcaaacaggctctaattgacgacaggccaaaatctattgaagattgtatcgcttgggctagaaatcattggcaagaacaatattcaaatcagatacgtcaacttcttttcaatttcccacccgatcagatgacaaccaatggccaaccattctggtcaggtcccaaaagatgccctgtaccattagtcttcgatgtgaataacgatctacacttggattacattctagctgctgctaatctcaaggctgaagtgtacggaattcctcaggtccgtgatagaagcttaatcgctaaagtagtacagagtgtacctgttcctgaatttactccaaaatcgggggtgaaaattgccgtaactgattcacagatggccaacggagctggtgggcaaatagatcaagataaaattggtcagttacagaatgaacttccatcgaaagaaatgtttaatggcttaaacatcacaccactcgaattcgaaaaagatgatgataataatcttcatatggatttcattgttgctgcatcaaatctaagagctgcaaattacaacataccagcagcagatagacataagagtaagttgatagctggtaagattattccagcaatagcaactacaacatctgttgttgctggtttggtttgtattgaacttatgaagctagctaaggggtataacgatataggtcagtttaagaatggttttgttaat

SEQ ID NO: 830 - DNA, 386 bp, Halyomorpha halys
atggttttgttaatttggcacttccattctttggattctctgagccgatatcagctcctaaattgaagtattacgaaaacgaatggacattatgggatcgattcgaagttactggagagatgactctcaaagagtttatcgattattttaaagacaaacatcagctggaaataaccatgttatctcaaggtgtttgcatgctttattctttcttcatggctaaaagtaaattggaagatagactcaatcttcctatgtcagaagtggttcgtagagtatctaaaagaaaactcgaacctcatgttaaagctctagtgttcgaactctgctgcaatgatacagatggcaatgatgtggaagtaccctacgtgaggtatacattgcct

SEQ ID NO: 831 - DNA, 668 bp, Halyomorpha halys
aacaacatacatttgtagaaactgattcagtgcggtatgtgtatcagccccttgagaaactttacatggtgctgattaccactaaggcctcaaatattttagaagatcttgaaacacttagactattctctcgtgtgattccagaatattgccgcaatatggaagaatcagaaattactgaaaatgcatttaatcttatttttgcatttgacgaaattgtggctctaggttacagggaaagtgttaacttagctcagattaggacttatgttgaaatggattcccacgaagagaaagtatacatggctgtaagacagtctcaagaaagagaagctaaaaataaaatgagggaaaaagccaaagaactgcagagacaaaggttggaagccggaaaaaaaggctacaaaactccaagtattgctggtttcggttcgtcatcaacatttacaagccctgttgttgaaactattgatctgcctaaacctacatacactcctgcgaaacccgtcttatcagcgaaagctatgaaacttggtggtaaatctagagacgttgaatcatttgttgatcaactaaaatctgagggagaaaatgtcatttctcaagtagctgcaaataaacctgtagtggcgaagttagcttctacaccaaatattcatatggaagag

SEQ ID NO: 832 - DNA, 334 bp, Halyomorpha halys
atgggcaatacagtttcggcagctcataaaactgctggtcaattggttggtcccctcgctttgggggaccagtctgatgtgaaaccaggcattgattattcttttattccagcagaatgtcctctgtataaaaaagatgctgcaaagagtgcttctaatgatgaaattaatcctcttaacatgatgcatcctccaaaccaaaagccagcacctgatcagccttttcctcttccaacaaaaagagaagtgtcatcgattcccaaagcaacaccacaatttgaaggagacaattattgggtttatccttcacagcagatgttttggaatgcaatgt

SEQ ID NO: 833 - DNA, 368 bp, Halyomorpha halys
tgttttggaatgcaatgttgaggaaagggtggaggtggaaagatgatgatttaaaaccaaaagatatggaggatattatcaaaattcataatgccaataatgaacaagcatggcaagaggtactcaaatgggaagcactccattacaaagaatgttgcactcctaaactaaagagttttggaggaaaagctcaagattattctccaagagcccgtatacgtcagttgatggggtatgaactaccctttgacaggcatgattgggtcgtggaccgttgtggcaaggatgtaaaatatatcattgactattatgatggagggtctgtggatcccaaacacaggtataaaattaacaatcttattgtggtt

SEQ ID NO: 834 - DNA, 708 bp, Halyomorpha halys
atgacttgtgctacccctgtatcgaagaaaaagaagtttgtggcagatggagttttccgagcggagctaaatgagttcctcaccagagaacttgctgaagaaggttactctggtgtagaggtccgtgaaactcctagtagaactgaaattataataatggcaacccggacgcaaagtgtattaggtgaaaaaggccgaagaataagggagttgacatctgttgtgcagaaacgctttaacttccaaccacagtctttagatctttatgctgaaaaagttccaactagaggtttatgtgctgttgctcaagctgagtccttgaggtacaaattgattggaggcttagcagtccgtcgagcttgctacggagtacttagattcataatggaaaacggagccaagggctgtgaagttgttgtttcaggtaaacttaggggccaaagagcaaagtcaatgaagtttgttgatggccttatgatccacagtggtgacccctgtaacgaatacgttaatttagccacacgtcatgtactattgagacaaggagtactcggcataaaggtcaaaattatgctgccttgggacccaacagggaagaatggacctaagaatcctctacctgatgatgtgtgcgtggttaatccaaaagatgaagttattccttctgatataaagactgtaacagtcagcgagcaccaagtgccgctg

SEQ ID NO: 835 - DNA, 336 bp, Halyomorpha halys
aagctcagtcaggtactggtaaaacagctacattttccatttccatattacaacaaattgacactagtgctagagaatgtcaggctctgattttggccccaactcgtgaattggcccaacagattcagaaagtagttattgctctgggagatttcatgggggccatgtgccatgcatgcattggtggtacaaatgtgagagaagatatgcgcaaactagaaatgggtgttcatgtgttggttggaactccaggacgagttttggatatgataagccgcagggctctaaaaacaaacaccataagaatttttgtgttggatgaagctgatgagatgc

SEQ ID NO: 836 - DNA, 200 bp, Halyomorpha halys
ttaaaaaagaagaacttaccttggaaggtattaaacagtttttcgtttttgttgagagggaagagtggaagttggatactctatgtgatttgtatgaaactctaagtattacccaagctgtaattttctgtaatacaaggcgcaaggttgattggctgactgagagtatgcataatagagacttcactgtttctgctatg

SEQ ID NO: 837 - DNA, 211 bp, Halyomorpha halys; identical to SEQ ID NO: 701

SEQ ID NO: 838 - DNA, 260 bp, Halyomorpha halys; identical to SEQ ID NO: 702

SEQ ID NO: 839 - DNA, 1646 bp, Halyomorpha halys
atgcggagtgtggccaaaatgcaacaaatggactccttgcaacctaacaacgcaacaggactggtgaaaagcggactagaggcgggggccggtagcggcatgaaagagcccccgccacgagaggagccggtcctagaccctattaacggtgttgtccagccaccggtcatacctccaccccacaggcctggccgagtaaccaaccagttgcaatatattcagaaaaatgtcctcaaagcagtttggaaacatcagtatgcttggcctctacagcaacccgttgatgccaataaactcaatctccctgattaccataaagttattaaacatccaatggatcttgggaccatcaaaaaacgactggaaaacaattactattggtgtggtgctgaatgtatccaagatttcaatacaatgtttaacaattgttatgtttataacaaaccaggggaagatgttgttgttatggctcaaacacttgagaaactttacttgcaaaagcttgaaacaatgcctaaagaagaaattgagttggagcccccaccacctaaaggctctaagccagtcaagaagcgacctggagttataggaccaggtcggggaggtgggactactggtgccggaagaggtaggccttctaattcaacggcagcagctgcggctgtagttgctgctcctgtaccgcctgctactcctccttcacaccttccagtgaccatacccggttcgactgctaccactactgtacctaccactcaccataactctcttcctcctcagaaaatgagtggctttgtaagttacggtttgcctttgccattacaggttgggcagtctgcagctataccctccaacttcaataccactactgttgatcctcttttaacacctggtttggctcctggtgtgggtccaaaaggtggcaaaggggccgtcgtccagaccccaacggcgcccaaaacgaagaaaggggtcaaaagaaaagcggatctagcgaatgatagccctgctgggtttgatcctacctacaccccaggtgactccaaagctgccaaggttggcacgaggagagaatctggaaggcaaattaaaaaggcttctcacgaaaagccaaaagaaaaactttctgaaacattaaaagcgtgcaatgaaatattgaaggaattattttctaaaaaacatttcaactatgcgtggccattctataaacctgttgacgctgaatggctcggtttacatgactaccatgatattattaagaaacctatggatctcggaactgttaagcaaaaaatggacaatcgagaatacaaaacagcaactgaatttgcagcagacgtcaggctaatatttaccaattgttataagtataaccctcctgaccatgatgttgttgcaatgggcagaaaactgcaagatgtttttgaagtgagattcgctcaagtacctgaagactcccctacatcgactgttcctgaaaaggaagaagaatccacctctgggtcatcgtctggctctgaatccgaaactgataattcagatgacgaaagggcccgtaaacttagtcaattacaagagcagctaagaattatgcaggaagaaatgagaaaacttgtagaagaaggtaccattaaaaagaaaaagaa

SEQ ID NO: 840 - DNA, 355 bp, Halyomorpha halys
aaaaagaaaaagaaagatggctcaggttctggtggaagctcttccagtaaaaaaaggaaatctgctgataggacactcagtaaaacagctgatggtgggcttttagctggagcgggagcacctgccatgatggaattgaaggctatggatggtgtgaaggctgcacctcctccaggcaggaacgctgtcccctcaccccaggtcaaaccaaacaagggcaaagcccctggaaggacaccaggcaagactaattctcagggtaagaggccaaagccgaactccaggtctgctaactcaaagaagaagaatcctgttgtcacctcagagttcaactcagaagatgaagataatgcta

SEQ ID NO: 841 - DNA, 422 bp, Halyomorpha halys
aagatgaagataatgctaagcccatgtcttacgatgaaaagagacaacttagcttggatattaacaagctaccaggtgataagcttggaagagttgtccacatcattcaggcgagagagccctctttgagggattcaaatcctgatgaaattgaaattgactttgagacattgaagccatctaccctgagggagctcgaatcctacgttgcatcatgtctcaggaaaaagccacgtaagccctacaataagaaagtatctgcaaaatcaaaagatgaagcaatggcagagaagaaacaagagctagaaaaaaggcttcaggatgttactgggcagttaggagggggatccgccaagaaacaagctaaaaagcagggcaagtcagggaaggctttcagcatcttcatcttcaagctcagattc

SEQ ID NO: 842 - DNA, 825 bp, Halyomorpha halys
cagcaccagcagcaacagcgcactcttgggctgacatcagccatcacacttgctggtcccaagcctatcgattaccagaagactaatgaacttatagagactcttaaaccgtacaatgttatggaaactgaggaagaactcaaccacaggatggaaatattaagcaagttgaacagcctggtaaaggaatggatcagagaggtgagcataagtcgtaatatgcctgaaagtgtagctaactcagtcggtggcaagatctatacctttggttcataccgcctgggcgtccaccataagggggctgatattgatgctctctgcgttgcacctaggcatatcgacaggtctgattacttcacttcattctttgaaaaattgaagttacatacggaagtaactgatttgagggcagtggaagaagcatttgttcctgttataaagatgaattttgatggtattgaaatagacatgttattcgctagacttgctctaaaagaaatacctgattctatggatctcaaagatgacatgttgctcaagaatcttgatcagaaatgtgtaagaagtttaaacggctgcagggtcactgacgaaatacttcggttagtacctgatatagaaaattttcgcctcacccttagaactataaagctgtgggctaaaattaatggctattttatttctttttcaaattttaatgtatctaaatgtctttacagctataatatattgcctcagaatcatttacaccttgttatcataattcaacttttaatgtttctgcatcaacaagaactattcttcaggaggcttttaataatggcc

SEQ ID NO: 843 - DNA, 203 bp, Halyomorpha halys
atgggagacaacgaacagaaagccctgcaattccttgcagaggccgaaaagaagttgacttccaataaaagtttctttggttcgctttttggaggtacttcatcaaaagttgaagaagctattgaatgttatcaaagggcagcaaatatgtttaaaatggccaaaaaatggggagctgcaggaaatgcattttgtgaagctgc

SEQ ID NO: 844 - DNA, 335 bp, Halyomorpha halys
atcaaactattgctgaaatgtatgaaactgaagcagttgatcttgaaagagctgttcaacattatgagcaagcggctgatttttttagaggagaagaaagtaattctgctgcaaataagtgtatgctaaaagttgctcagtatgctgcacagttagaaaactatgacaaagctattcaaatttatgagcagtatggtagtaggcctgctttactaaaatgcttatcaaatgtaatggagcataataattttacaaaggttgatatttttaggttctacattttttgttatgtacgactttaccttcttagtctatataatatagagtctgcttct

SEQ ID NO: 845 - DNA, 329 bp, Halyomorpha halys
accatcatcgtatcaacttcgacaagtaccatccaggatattttggaaagttgggtatgaggaattaccatcttagacgtaatcagaagttctgtccctcattaaacttagataagctatggacattagttactgagcaaaccaggcttaagtataaagatcacccggaaggcaaagccccagttatcgactgcatcagggcgggttattacaaggtccttggaagaggacaattgcccaagcaacctgtcatcgtacgagccaagttcttctctaagtatgctgaaaggaagatcaaagccgttggtggagcttgcattttatctgct

SEQ ID NO: 846 - DNA, 270 bp, Halyomorpha halys
atgggtatcgaatttcgagagagctctctgcttattggaccaaaaactcaaaccattgctctaaaaacacaagtttacaacttgaatgctggtttatcaggactttctaatagtgaagctaaggaaaaagaaggaaagacgtatgctctatttattggtgatacagtgatagttaacgagggtacccctgcttcaatcttgacaccagcaagaaagaaaatgaagaatattggtgtttttcttaaagacggggaagaggatgaagatgag

SEQ ID NO: 847 - DNA, 365 bp, Halyomorpha halys
cagaagtaaaagaactgaagatttttgttgataggaagtatgaaacagttatacttcctgtatttggaatacctgtacctttccacatctcgaccattaaaaacatttcccaaagcgtagaaggagattatacttaccttaggataaattttttccatcctggagccactatggctcgtaatgaaggtgccgcattcgctcaacctgatgccacatatgttaaagaagtgacctaccgaagcacgaatacgaaagaaccaggagaaactgtagcaccatcgtctaatttaaataatgcattccgtatcattaaagaagtacaaaagaaatttaaatctagagaagcagaggagaaagagaaagag

SEQ ID NO: 848 - DNA, 281 bp, Halyomorpha halys
ggagaaagagaaagaggatcttgtcaaacaagacgttcttgtactttcccaaaataaaggaaatcctaaactgaaggatctttatattaggccgaatattgtcaacaaaagaatgacaggatctttggaagctcacacaaatggatttcgttatacatcggtccgtggtgataaagtggatattttatacaacaacataaaaaatgccttctttcaaccatgtgatggtgaaatgattattcttttacattttcatttaaggcatgcaattatgtttggta

SEQ ID NO: 849 - DNA, 1003 bp, Halyomorpha halys
ctgctcaactgcctggctggccgggtcaaactggacgcaggcagtatcagactgaatagggagagactgaacaagaggtggaagcggaggatatgctacgttctgcagcaggacatcttcttccccgatctaactctcaggcagactttggagtacgcggccctgttgagactgccggactcgctctctcactcgcagaagatgcagtacgtggaccacatcatcgacgtcctcgacctaggcaactgccaagacacgattattggtgactacctgaaacgtggtctttctggaggtgagaaaaagagagctaacattgcctgtgaattgctcacaaacccttcactcatgctgctcgatgagcctacgtctggcttggactcgcattcagcatattccctcatgtgttgtctgaagcgctacgcagagaaagaagggaagacagtggtggttacggtacatcaaccttcgtctcaaatattccacatgtttgacaagctccttctcctatgcaatggccaaactgcttattttggtgacacaaatagtgttgtagattttttcaacaacattggactgaccgtgatgcctcactataacccagctgacttcattcttgagcaagtaaaaggaagtgaagaaatgaaggaaaaaatcattgccgcatcgagagaagcaaggctgagagctgactatccccatgaactattgcctgaatatttcaaccccaccatctgtgataaattcctcaacaattatcatgaaacccagatccatcagtctaacggtcaagtcggcagtggatgtggctgtcaacaggaaatgtggtcaagaaatggaaatactcaaactgggcaggatccagtctgcgtgactgttgcacttggagaaacaactgagtcacatggaaatgtttatacaaccatagctgttaaagaagatgaaggaaaaacactatggttagataaccaaagccacgcttcttcatctgtcagtagtagtg

SEQ ID NO: 850 - DNA, 881 bp, Halyomorpha halys
catctgtcagtagtagtgatgatgacgtcagctggcaatggccaacaacattctggacacagtttaaggtgctgagccagcggaacttccaggaagctagaccacggatgctgtccacgctgaactgggtacagacaattggcctgtccataatggcaggcctcctttggttccagctccaacgcactgaagagtccctccatgatatacaaggatggatgtttttctctactacgtactggatgctcttttcacattttggtgctctctcatcatttcctcctgagagagaagtaataaacaaggagcgacagtctggagcgtacagactgtcagcttactatttggccaaaatggttggagagctgccactaaccatcactctccccgcagtgtatcatatcatatcttatccaatgctgggccttcacagtacgactgtcttcgtcactcttctaggcttcctcctccttaacactattgttgcccagagtgttggattctttgtcggtgcatgttgtatggatatgcaggtttccataacaatttcagcgctatatacactcgctacacaactttttggaggatacctagcaactaacataccaccatggttgaagtggatgcagtatctcagcatggtacactatgcttaccaaaacatgcaaatagttgaattcagtgaaggtgctcaaattcagtgtgctcctcaatctaaattcgaagtgtgtaaaaattctagctacattccagtctccgccattctggagcaggaaggcgctagcctgccactctgggctaacactctcgtccttctcctattccttgtaatattcaggcttctcggctatatcgtcctcaggtacttccgacgacccaaa

SEQ ID NO: 851 - DNA, 3687 bp, Halyomorpha halys
atgcgtcagttccgttccatagtgtggcatggaactgataacgcggctctgcgtgatcggtgcgaggcagtcgacgtgatggaggtgccattactgctgctttttgtcgctattgtggccggcaaagatgtgaacaacaaagtgagtgagaagttggtccgcccttatgccaggaacatcaataccaggttacgtgggtacggcaacaatccagtaccaaacgccgaggatgatcgaacggctcctaacactgaccaaccgagtattccttatgtgataacggaagatcggctaaagaagataagatccaactttatgtattggttcttcgaccaagacctggaaggcggttacggagatttacagaaggatataacaccatcaattacacaagttaataaaaacttaaattttcaactgccgttttttggattccgcttcaattatacaagagtttcactaaacggctatttggaattcagtgaccctccagaacaatatagttaccctctcactttcccgacagtagaatggcctaaaaaaaatgatccttcattcattggaattttctacagtaagtgcaggatcggtcaattgggtatcaatgatgtcgaccagagagaaccaggagtttatttcagaatggaaagggacttgatgtcacgaaaagacaaattcggagtcgaagtgagagagaggctgaggtgggacattcgagagagtgtcgtcggctccgactcttttgaaccaaagcatgctgtaatcatcacctggaagaatgtttcatttgccggtggtattgaaaactcagtacaaaaaacaaacacatttcagatggttcttgcaaccgacgaagtgttcacttatgccatattcaattacgttcaaatcaaatggactacacacactgaagcacgtggagacacagtcggaggagaaggtggtgttccggcctatgttggatttaatgctggcaatggcacgaggaattatgaatacagaccatattcacaggcatctacaatcagagatttgacagcccgtggttgggctaatggtttccctggaaggcacatttttagaattgatgaaaatattctccctggaacttgtaacaaggatattgctggagcaagtttgcccctcacattcgcacctgaaagcggcaacatgcttggtggtaccattgtcaatataacaggaccttgttttgaaccgaatatgaagattgtatgcagatttgacatgaaagctgtgtacgggactgttgttgacagaaatagagccatttgtgttcaacctttcatcatggcagaaggctacattttgtttgacatcgccattgatgatggaaaatacgtttggaaaggacaatatttcattgaaacaccagcgacagccgctgaaaaaatatctttcgctgacgacagtgtccatcaaaaatatcctccagaagtcagaataacatggaatcaatataacttgacttcaaacttagctgctccagttcaaatctcaatttggggttacagggaacaatcgattcgccctcagctgctttatatagattctctagatatcggcgttccaaataatggcttgtacacaatcataccagcaacttataaaaatcgtgataatcgtttattcactgatatgagtttcggattcatacaaatcaacctgacgtcctcaacggaatacaatggactcagagtaacaccagtcatctggagcaaaccaatacctttgggttggtacttcgctgcacaatgggaaagacaactaggttccaattggccggaagggaaatgtaacacttggattatgaacgaccgatatttgaagaacttccctgcagaactgagcatatgtccttgtaaactggaacacgcccttgctgacaagggaaggttcatgccagattttgactgcgatatggatgccaaccctcactgtttctatcacgaaggcgccaggcactgcgtaaaaactggagctcccaggcaagaaggttctgaacagcaatgctgttatgacaaaaacaattatttgatgctttcttatgatcaacagtggggttcatcgccaaagaggtctagtaatttaggaatcttgccatggaatgaaccgaacaaggtaaaatattacaataaaataagattaagggtgtttgaaagaagaccatcacaggactgtgttggttaccaatcaccttacatcgcaactgtttttggagatccacatttcattacatttgatggtttggaatataccttcaacggcaaaggagagtttgtgctactgcacacagattctgaaaagtttaagttggatgttcaggcaaggtttgagcaagtaggaaagaacatttacggtgatgtggcagcaacacagttaacatccatagcagcaagagacaatacttcaagcatcattgaaataaggcttagaccaaaggaggcacaatggaggtacagactagatgtttttgcaaataagaaaaggatatattttgaccggccagctcttcgtgtacagcacttcacaggagtcacagtttatcagccttcacacatactgaatcagtccgaaattgttatcatgtttcaatcaggtgttggagtagaagttgttgaaaataaaggatacatggctgcgagggtttatttgccttgggaatatataaacagaacaaggggtctgttcggaaattggagttttgatccctccaacgatttcactctaccagatggaactgtggtcagtgctgacagcctaaatgatttggagagaatacacaaggaatttgcaattttttataatatttgtgattatttcaggacaaaagatatacaacaagctctagctctttgtggtgaatcttaccaatgcagatatgattatgctgtcactttgaacagagaaatggccttttatactctaaattattacagcgaatatacttcactaagacaaaccaataaagacagagttttgtcttgtggagtgttggaaacaccaagatttggacgaaaatccaattttttctttgttcctgattctaaggtgatatttgaatgtgatcaaggatttattttggtgggtgatcaaaggcgaacatgttcttctagtggcagatggtcttttgattatggatatactgaatgtctgcggtacattgaatacgatgcgcagcaaattgcaaaaacagtgatggttgttgggctgatcttgatacctcttattatggtcatagtatgtgctgcagtatacataataaggaaagccaaaggagatagttcacaagtttcctggaaattttccaaagctccttcgacctcatatataccagctaagacacatccttctcaagatccccatcaggcttcagctccattcttgaagaatgatgatagccctgacacaacaagaagtatcggatatcctggtcattcaaatatgtcactagataaaactcaagggatgaaaccaatactgtctttgccttatgacaaatcttattacacacatgaaccattggcaaacagaccacctattgactttgaggattatgaagaagaaggattacaacaatcaggagactataacaatcctaatgatgctccaactctcaaagttaaagatgatttaagaaggcataatagtatagaaacagatattttc

SEQ ID NO: 852 - DNA, 605 bp, Halyomorpha halys
ccatcaaggagctgcgaccgctttagctgctatgaacaaacgtgtgtttctggaaaaagaaatgaaagttaattgggctacttctccaggtaatcaaccaaaattagatactagcaaccatcaccatatatttgttggtgacttgagtcctgaaattgaaactcaaactttaagagatgcatttgcaccttttggtgaaatttcaaattgcagaattgttcgtgatccacaaacccttaaatctaaagggtatgcttttgtttcatttgttaaaaaagcagaagctgagaatgctatattagcgatgaatggtcaatggcttggaagcagaagtattcgaacaaattggtcgacacggaaaccaccaccaccaagagatagtagaaatcgtcaaaacaatgctaaagctcctacatttgatgaagtatacaatcagtcaagcccaactaattgtactgtctattgtggtggctttgttagtggaatctcagatgagttaatgcaaaaagttttttctccttatggtactattcaagatatcagatgctttaaagataaaggttatgcatttatcaaatttacaaccaaggaagctgctactcatg

SEQ ID NO: 853 - DNA, 437 bp, Halyomorpha halys
aggaagctgctactcatgctattgaatctgttcataatactgagatcaatggacaggttgtgaaatgtttttggggtaaagaaacggctgatcctaatgctgctttaaacaattctagtaacgctaatcaggttggagctgctcaatggtcatacatgtatggtaatatgggaggaggttattggtacccacagggatattctacaccccagatgcaacaacagtatctacaaggtatgcaaggatatccatatggccagtttggttatcagcaaaattatgtcggtagaatgggtatgcagatgccagcaggttcgtggcctgtgattggtgcaccttctggaagcgcacaaggaaaccaacaaatggcacaagcttcaggtatgcaacctccaaacaatatgatggcctatactatgcaacagtttcaaacacag

SEQ ID NO: 854 - DNA, 209 bp, Leptinotarsa decemlineata
atggcaaatggaccaatagcagaaagaaatcgagatgctactatatatgttggaggcttggatgacaaagtgtcggaatctcttttatgggaactttttgttcaagctggaccattggtcaatgttcatatgcccaaagatcgggtaactatgatgcatcagggatatggattcgttgaattcatgggcgaagaagatgctgactatgc

SEQ ID NO: 855 - DNA, 245 bp, Leptinotarsa decemlineata
ttaaaataatgaatatgattaaattatatggaaagcctattcgagtcaataaagcctccgcacaccaaaaaaatttagatgttggggctaatatcttcataggaaatttggatcctgaagttgatgaaaaattgttatatgacacattctctgcattcggagtcattttgcaaactcctaagctgtctacttctcatcaagagtaccatctaagatatggaatttgtttctggggaaatcatttc

SEQ ID NO: 856 - DNA, 354 bp, Leptinotarsa decemlineata
atggtggaggatggtggtgaatacacgtgcacagcagaaaacagagcgggtaaaagttcccattctgccaggctgaatatatacggaatgccctacatccggctgatcccgaaagtgaccgccgtcgcgggtgagacgctccagctgaagtgtcccgtggcgggatatcccatcgacgagatccactgggaaaggggcggcagggagctgcccgacgatctgcggcagaaagtcttgggggacggcacgctcgtcatcaaccccgtcgaaaaaaaggccgactcgggggtgtacacgtgctgggcgagaaacaagcaggggcacagcgccaggagaagcggagaggtcaacgtc

SEQ ID NO: 857 - DNA, 340 bp, Leptinotarsa decemlineata
atgccctctagtaatccattaccaccaaaagaaaatgccttatttaagagaattttgaggtgttatgaacaaaagcaatacaaaaatgggctgaaattcgcaaagcaaattctgtccaatcctaaatacacagaacatggagaaactcttgctatgaaaggacttactctgaactgcttaggacgaaaagaagaagcctacgaatacgttcgtagaggtttaagaaatgacttgcgttcccatgtttgttggcatgtttacggacttctacaaagatctgacaaaaagtatgacgaggcaatcaaatgttatagaaatgctctcaagtgggagaaggata

SEQ ID NO: 858 - DNA, 1541 bp, Leptinotarsa decemlineata
tcaagtgggagaaggataatattcagatcttgcgagatttgtcactcttgcaaattcaaatgcgggatttggagggatacagggtgttacctgtttccgttaatgatactcgatatcaactacttatgttacggccaatacaaagagcttcctggattggttatgcaatgtctttccatctgttggaggaatacaaaaatgctcttagcatattggagacctttttggagcagcagaagggaggcaattttgactatgaacacagtgaactcatcctttaccagaacctcgtgatccaagaatccggcgacctaaaagaagccctacaacatctagaagattcacaggatcaaatcgtcgataaactaactttgaaagaaaagtttggcgaattgcatttaagcctgaagcagcatgacaaagctgctgaatattacgaacagctcatccaaagaaacccagaaaacacgatatactacaagaaactgatagaagcgaaacagttgactaaaccagaagaaattgttgatttttacgcaaagtacacggaaaagtttccacgtgctatgccacctagaagactgccactgaactatgcgaccggagagcagttcaaactcctagctgataaatacatgaggaaagccctctcgaaaggggtccctccactgtttgtcgacatcaggagtacttacgcggaccaaagcaaagtggaactgatagagaatttactgctgcaatatgttgaagctttaaagaaagtaggtaaatatagcgagacggaggtaaagaatggaccaaaggaaccagcaagtgcattactgtgggtgtattattatttagcgcaacattatgactacctgaatcagactgagaaagctttgagttatatcgatgctgctatcgaacacactcctacgttgattgagctgtttgttgccaagggacggatatacaaggggtcacacttcggtctcttattgttcaatttatttattaacgacattattcattgctttcggcacgccaaagcactattatttgcagatgatttaaaacttctcctaattattgaaacctctttggatgcccataggcttcagtctgaccttgacaatctatcaaactggtgctccttaaatggcatggacttgaatgccacaaacttcaatgtacatatacccacggctatccatgaagccatgaaaatgatatggtttatcaaacggctaacccacgaattaactgacccaactgttattaaagccctttattgttcactggtccatccacacttggagtattgttcttctgtctggtcccctcattcaccaatctggaaatcattacaacataaagcacaatcagtggcatacggaatcatagtctggagacaatcactttctgccaaacgtctattcattatacagaaaaagtgcatttgtgccatgttatgcaaaccccagaagaatctagtagacctctctttagaaagccacaagtattacccttcatttctcttttcatcagaaactgcttgt

SEQ ID NO: 859 - DNA, 343 bp, Leptinotarsa decemlineata
atgggattctaccctaagaaaaggtcccaaagacatcgtggtaaggtcaaggccttcccaaaggatgatccttccaaaccagtacatctaactgcattcatgggctataaggctggtatgacccatgttcttcgagaagctgatcgtcctggatcaaagataaacaagaaagagatcgtagaagctgtaaccattttggaaactcctccaatagttatagtaggcgtagttggttacattgaaactcctcatggacttcgtgctttggctactgtttgggcagagcatctttctgaagattgccgtagacgcttctataagaattggtacaagagcaagaaga

SEQ ID NO: 860 - DNA, 764 bp, Leptinotarsa decemlineata
agaagaaggcattcaccaaagcttcaaaaaagtggaatgatgatttgggtaaaaaatccattgaacgtgacttcaggaaaatcgtcaaatactgtaaagttgttagagtgattgcacacactcagatgaaattgttgaaacaacgtcaaaagaaggcccacattatggaaattcaattgaatggtggcacagttgctgataaagtagcctgggctagggaacacctcgaaaaaccagttcctgtgagcaatgtatttgcccaagatgaaatgattgattgcattggtgttaccaaaggtcatggttataaaggtgtgacttcacgttggcacacgaagaagttgccccgaaagacgcacaagggtctccgtaaggttgcctgtattggagcatggcatccttctagagtttcattcaccgtcatcaagaacaatgcttcaactgaatacgatttgagtgaaaagtccatcaccccaatgggtggcttccctcactacggtgaagtcaataacgactttgttatgatcaagggttgttgtattggacccaagaagcgaattataactcttaggaagtcgcttctggtacacaccaaacgtgttgcgctagaaaagatcaacctaaagttcatcgatacatcgtccaaatttggtcatggtagattccaaactgctgccgataaggccgctttcatgggacctctcaagaaagatagaaaagaagaagaaaaagttgcttcagcaccagctgctgcatctagttca

SEQ ID NO: 861 - DNA, 330 bp, Leptinotarsa decemlineata
gacttggaggaggtatgccaggtttgagtcaagcacctcctccttcagatgcacctgtggtagatacagctgaacaagtgtatatttcctctctggctttactgaagatgctgaagcacggccgtgcaggagtaccaatggaagtaatggggcttatgttaggtgaatttgtagacgattacacagtcagagttattgatgtatttgcgatgccacagacaggtacaggtgttagtgtagaggctgtagatccagttttccaagctaagatgttggacatgttacggcagactggtagaccagaaatggtggtgggctggtatcattccc

SEQ ID NO: 862 - DNA, 305 bp, Leptinotarsa decemlineata
aaaatgaactggaacagaaaatgcttctcaacttacacaaaaagtcctggatggatggccttaccttagcggactatgcagagaactgtagtgtaaatgaaaaaaccgtgtctgacatgctggatttggctaaaaattataacaaagctctagaagacgaggaaaagatgacaccagagcaactagcgatcaagaacgtcggcaaacaggatccgaaaaggcatttggaggagaaagttgacgttttaatgacaaataacattgttcagtgtttgggagctatgttggacaccgttgcatttgaa

SEQ ID NO: 863 - DNA, 260 bp, Leptinotarsa decemlineata
atgtctctggtcatacccgagaaatttcaacacatccttcgtatcttgggtacgaatatcgatggtagaaggaacgtgatgttcgccatgacggcgatcaaaggagtcggtagacgatatgccaatatcgtcctcaaaaaagcagacgttgacttgaacaaacgtgcgggagaatgtacagaggaagaggtagaaaaaatcatcaccatcatgtccaaccctcgtcagtacaaaatccctgactggttcctcaacaggca

SEQ ID NO: 864 - DNA, 212 bp, Leptinotarsa decemlineata
ggttcctcaacaggcagaaagatatcatcgatggtaaatacaaccagttgatgtcttcgagtctggactccaagctccgtgaagacttggaacgcatgaagaagatccgtgcccacaggggtatgagacactactggggtctccgtgtgagaggtcagcataccaagactaccggcagacgtggacgtactgttggtgtatctaagaagaag

SEQ ID NO: 865 - DNA, 327 bp, Leptinotarsa decemlineata
atgccaccaaagttcgatcccactgaagttaagtatgtttacttaaagtgtgttgggggcgaagtgggagctacatcttccttggctcctaaaatcggtcctctaggattgtcccccaaaaaaattggagatgatatagccaagaatacagccgactggaaaggtctgaaaatcactgtccagctgaagatccaaaacagacaggccaccatttccgttgtaccttctgctgcctctctcatcatcaaggccttgaaagagcctccaagagataggaagaagcaaaagaatagtaagtttttaatgttgtttacaaattttttctca

SEQ ID NO: 866 - DNA, 241 bp, Leptinotarsa decemlineata
ctgaaaaaggaaaaagcattacatcctttggatattgatgcctattggttacaaagaagattgtcaaaaatatatgatgatgccatggattcccaccaaacagcagaaaaagtgcttaatgttttgagagatgcaaatgatgatagggaatgtgaaaatcaactagttcttcttctggattcctctttgaaacgtattttgaaactattggagacaggaagggatgatgatgatgatgata

SEQ ID NO: 867 - DNA, 1441 bp, Leptinotarsa decemlineata
atgatgatgatgatatagatggtgaatccacttctagaacaaagcggcgaaagaaggagtctcatgaaatggatttggcaagtgctcaagttgcgggttacgaggaagttcatgtcccagctttgaaacagaaaccatatggagagaatgaaaaactcattccaattgatcaacttcctacatatgtgcaaccagtattcgacggttataaaactctaaatcgaatccagagtagactgtgcaaatctgctttggaaacggatgaaaatctactaatttgcgctcccaccggagccggtaaaactaatgtagccttactgtgtatgatgcgagaaattggcaaacatattaatcagaatgggactataaatgcacatgacttcaagatcatctacattgctcccatgagatcgctggcccaagaaatggtaggaaactttagtaaaaggctggcaagctacaatatgactgtttcagagttgacaggtgatcatcaactgactagagaacagatagcatctactcaaattatagtctgtaccccagaaaagtgggatattgtaaccaggaaaggaggggagaaaacgtacacctcgctcgttcgattgataatcattgatgaaattcatttgttgcacgatgagagaggaccagttctagaagctcttgttgcaagaactattcgtatgattgaatccactcaagaggatgttcggctagtaggtctctcagctacacttcccaattatcaagatgttgcagcatttttgagagtaaaatcttctacaggtttatttcattttgacaacagttaccgtcccgtggctcttgaacagcagtacattggggtgacagaaaagaaagctttgaagcgatgccaagtcatgaatgaaattgtttatgagaagacaatggaacacgcaggcaaaaaccaggtgcttatttttgttcattcccgaaaagaaacaggtaaaactgcgagggccataagggatatgtgcttggaaaaagacactctaggaaactttttgcgtgaaggctcagcttccatggaggttctgcggacagaagcagaacaagttaaaaatcacgagctgaaagatcttcttccgtacggatttgctatacatcatgcaggaatgacccgtgttgatagaactttggtagaggatctctttgccgatagacatattcaagtacttgtatccactgccacattagcttggggtgttaatcttccggcacacacagttatcatcaagggaacacaaatttataatcctgaaaagggaagatgggttgaactaggtgccttagatgtacttcagatgttgggtagagctggtcggccccaatatgacactaaaggagaaggtatactgataaccaatcacagtgaacttcaatactatttgtctctcctaaatcaacaattacctat

SEQ ID NO: 868 - DNA, 1580 bp, Leptinotarsa decemlineata
attacctattgaatcacaaatgatttcaaagcttcctgatatgctcaatgcagagatagttctcgggactatacaaaatattgatgatgcagttcattggttgggatatacttacttgtatataagaatgctccgacagcctactctgtatggaatatctcatgatcaaataaaacaagacgaaaaactgaagcaacatcgaatcgacttgatccatactgctgctctccacttagacaagagtggtttaatcaagtatgatcgcaaaatgggccagttccaagtaacagagttgggaagaatagcatcccattattattgtacttacggatcaatgcaaacttacaatcagcagctgaagccaatgttgagtgatattgaattgttcagggtgttttcgctatcaagtgaatttcgaaatataacggtgagagcagaagaaaaaatggaattacaaaagttaatggagcgtgtgccgattcctattaaagaaagcatcgaagagcctagtgccaaagtgaatgttctcttacaagcctatatctcccagctcaaattggagggttttgctctcatgtctgatatggtatatgtcactcagtccgcagctcgcttaatgagagctatatttgaaattgttttgcatcgaggatgggcacaattggcagacaagtcgttgtctctgtgtaagatgattgacaagcgtatgtggcagtcaatgtcacctttgaggcagtttaggaaaatgccagaagaaatcgtcaagaaaattgagaagaaaaactttccctgggaaaggttatatgatttgggtccgaatgaaattggagagctgattcgtgttcctaaattgggtaagactatccataaatatgtgcaccagtttcctaaattggaactttcaacacatattcagccaataactagatccatgctgcaagtggaactaaccattaccccagattttaagtgggatgataaactccatggagaatcggaagcattttggattctagtagaggacgttgattctgaagtgattctacatcatgaatacttcttactgaaatccaaatattgcgaagatgaacattcggtcaaattctttgtgccgatatttgaacctttgtcacctcactactttttacgaatagtttctgatcgatggataggggtggaaacgcaactgcctgtttcatttaagcatttgattttacctgagaagaattatcctccaactgaattattggatctacagccacttccaataacagctctcaggaatgagaagtatgaggcactatattctgataaatttccacagttcaatccaatacagacacaggtattcaattccatttataacggtgatgacaacatattcattggagcacctactggatcaggtaaaacgacgatagcagaatttgctatcttgagattatttgagaggaatcctgaaggaaggtgtgtgtacatggtaccgagagatgctttagctgagctcattttcgccgattggcacaacaagtttggccagagcttgggtagaaaagttgtacttttgactggtgaaacag

SEQ ID NO: 869 - DNA, 527 bp, Leptinotarsa decemlineata
ttttgactggtgaaacaggtaccgaccttaagcttcttgcaaaaggacagatagtaataacaactgcagaaaaatgggatgttctttctcgaaggtggaaacaaaggaaaaacgttcaaaatataaacttgttcatcgttgatgaactacatctgattggaggggacgacggtcctgtcatagaagtcgtttgttctaggatgaggtacatctcatctcagattgagaaaccgataagaatcattgctttaagtgcttccctgacggattataaagatgttgctcaatggttaggctgcaatgctaatgcatattttaattttcaccctagtgttaggcctgttagcttagagctccatgttcagggtataaatataactcacaacgcttcaaggttaatagcaatggccaaacctgtgtacaatgccatcctgagacatagtcctcacaaaccagtaatagtttttgtaccaactagaaagcaagctagaatgactgcgatagatttgctgacctatgctgttgct

SEQ ID NO: 870 - DNA, 1217 bp, Leptinotarsa decemlineata
tgacctatgctgttgctgagggacatgaaaaaaaatttttccatgcagaagaagaagatattaagccattcttggacaggatgtcagataagacattgaaggagacactgtcacaaggcgttgcttacatgcatgaaggtttaacagctagcgacttacgtcttgtggaacaactatttgattctggggctgttcaggtagccgtagtaactagagatctgtgttgggccgttaatattttcagtcatttagttgtgattatggatacacaattttataatggaaaagttcatgcttacgaggactatccaatcactgatgttctccaaatggtaggaagagccaatagaccattagaagatgatgatgccaagtgtgtgctgatgtgtcagagttctaaaaaggatttcttcaaaaagtttttgagtgatcctttaccagtggaaagtcatttggatcacagtttacatgatcattttaatgctgaaattgttacaaaaaccatagagaataaacaggatgcagttgattatctaacctggacttttgtgtacagacgtttgacacaaaatccaaattactacaatctccaaggagtaactcacagacatttatcagaccatttgtcggaacttgttgagacaacactgtcggctttggagcaatcaaaatgcataagtatcgaagaggaaattgattgtgtgccattgaatctgggaatgatagcagcatattattacatcaactatgcaactatagaattgttcagctcttctctgaacagcaaaacaaaaatcagaggattactggaaattatttcttctgcagaagaatacgaagacatccctgttcggcaccgtgaagaccacatattgagacaacttgcccaaaaacttcctaacaaattaactggggatcaacccaaatttaacgatcctcacgttaaaacgaaccttttgcttcaagcccatctgtgcaggttacagcttggagcggaacttcaaggagatacagaaattgttcttgctaaagccataaggcttattcaagcttgtgtcgatgttttgagttcaaatggttggttgtcgcctgcagttgctgctatggaattagcccagatggtaacgcaagcaatgtggagcaaagactcatatttgaaacagctgccgcattttaataatgagatcatcaagagggtgtcgaaacagtttttgata

SEQ ID NO: 871 - DNA, 341 bp, Leptinotarsa decemlineata
taaggacggccttcagcccgtcgcaactcttgaaattggaacacgctttcgagaagaaccactatgtagtaggcgctgaacggaaacaattggcgcagtcattatcactaacggaaactcaggtcaaagtatggttccagaataggaggacgaaacacaaaaggatgcagcaagaagaagaagccaaaacgaaccattccggtagcaaatcgggttcccccagttcacaaaacaacacacaccacgtgaacaagtggaaagaagaaacagcagacgaatatggggagtacatcgatatggatatggaagatgaatgtgttagtgatgtggaaagcgagtca

SEQ ID NO: 872 - DNA, 514 bp, Leptinotarsa decemlineata
atgtctaacaccgcttttacaaaaaatgaaatattcggtcttgtggtgagattaaccttggtttcggctgttactttctttagtatcaagtggataatgaaccaagtggatccgactaataaaagcaagaaaaaggctaaacagacagcaaaggaacagctaaaaagattgaccagtaccggaaatgctccgctaaagattgataaactcaatgattacgaaatgatgatagcagcccatttagttcacccgcaagacatcacagtcacatgggaaagcattgcagggctggaggaccttatccaggaactgagggaaaccgtcatactgcccattcagaagaaggagctgtttgcttactcacaactcacgagtgctccgaaaggcgttttactacatggaccacctggatgcggcaaaactctcattgccaaagccaccgcacgagaagctggtactcgcttcataaatctagatctgtccatactgacagacaaatggtatggtgaaagtc

SEQ ID NO: 873 - DNA, 487 bp, Leptinotarsa decemlineata
gatgaaagctcagtttatgtctctctgggatggacttatcacagattccaattgcacggtaattataatgggggctaccaataggcctcaggatttggatagggctattttgagaagaatgccggctacgtttcatgtacccatgcctaatcttggacaacgcagagaaattataagattgatccttgaaaacgaaccgatagcagaggatgtgaactatgatgaattagccactatcacaaatggcttttccggctcagacttgagggagctgtgtcgaaacgcttcagtatacagagtgagagactatgtgcgggaccactttgaacatgcctatccaaacacaagccagaacgagtctgaagagaaattctatgatactcttcggcccattacgatggcggatttgaaatattcgtataacaaaatgagggatagcaaagttcagtgcaataccttgtccttacagactagaatagatctggat

SEQ ID NO: 874 - DNA, 400 bp, Leptinotarsa decemlineata
ttgctccatcactttcggaagtacacttttgatcgctgtcagttgtcacttccaacttccttctttcaattgtccacaatgcaggcgcctacacagaagccgaaaaaggaaccaatccactctgtccaagtttttggcagaaaaaaaacagctaccgcagttgcatattgcaaaaggggtagaggagtactaagggtcaatgggcgccctttgagccaggttgagcctaaaatgctccaggacaaacttcaagaacccattttgcttcttggaaaggacaagttctctgcagtagatgtgagagtccgtgtaaatggtggaggacatgtttcccaaatctatgctattaggcaggcgatatccaaagctctggtagcgtactatcaaaaatatgttgatg

SEQ ID NO: 875 - DNA, 1041 bp, Leptinotarsa decemlineata
atgggcattgccgaacaagccttagatgccaaacaacaggcagcgtccccggaggatacggaggatctgtcgcctttgccggcgcacgcgcagcaaccggtcagacgcaggggcggcatctccgcagaaccggtctccgaggaagacgccaccagctacgtgaagaaggtcgtcccgaaggattacaaaacgatggcggccctctcgaaggccatcgccaaaaacgtgctcttctcccatctggacgagaacgagcggtcggacatattcgacgccatgtttcctgtcaactgtcttcctggcgaggccatcatccaacaaggcgacgagggggataatttttacgttatcgatcaaggggaagtggaggtttatgtaaataatgagttggtgacgacaataggcgaaggtggtagttttggcgaactggccctcatttacggtactcccagggcggccactgtgaaagccaaaacggacgtcaagttgtgggggatcgatcgggattcttacagaaggattctcatgggttccactataagaaaaagaaaaatgtacgaagagtttctttccagggtgtcgatattggagaatctcgataaatgggaacgtcttacgatgtctgtcaactccagcagaactgagataatccccttcaccaggaggaaaacattggacgatctaacgccacttttcctcaatggtgaggtcactccatttggtacggaggtgaaatatcttggcattgtccttgataaaagactcgcctggaacgctcacttggaaaaagttttacacaaagccagactgtctctatggacatgtcgaaggatttgtggcaaaacttgcagtttaggtcccaaacaaatccattggatttgtgttatgattgtcagagcaatgatggtacaattgcctgatggcaattggtctagattcctggccatgttgacctggaaggcaattaggctgctgactcccttgcaaaggaggatgctgcaagcagcttcatcggaccagaacctatcattggcatcgctt

SEQ ID NO: 876 - DNA, 670 bp, Leptinotarsa decemlineata
atgcctccaacgatccagcaaagcggtcaaagtaccgccaatggtgtggagaaaagacctgtaaaacccgtggaaaaaaggtcagatttaatatgtaaagttaaatattgtaatacgttaccagatattccgttcgatttgaagttcatatcctacccttttgaatcgataagattcatacagtacaatcccacttctttagaacgcaattatcggtatgaagtgctaacggaacatgatttaggagtaagcatcgatctaatcaataaagatatatatgcaattgagccaggtgcatatttagatccagccgatgagaagctgttagaagaagacattttgacgcctcaggactctaaaagatctcggcaccatgctaaatcagtatcatggctccgccgtacagaatatatttcaacagaacaaacccgctttcagccccagaccatggacaaggttgaagccaaagttggttacagcatcaagaagtctcttaacaatgagacattgtatatggatcgtgattcacaaatcaaagccattgagaagacgtttgaagattctaaaatacctatcgagaaacattatagtaagccgaatgtggtacctgttgatattcttcccgtgtatcctgacttcaatctgtggaagtatccttgtgctcaagtca

SEQ ID NO: 877 - DNA, 1454 bp, Leptinotarsa decemlineata
aaattgaagaaatgtcacaggctatgattcggggtgtcatggatgagagtggtgaacagtttgttgcctactttcttcctacggaggaaaccttgcagaagcgaagggaagattttgcaaatgaaataccctatcaagatgatgaggagtatgaatataaaatggctagagaatacaattggaatgtcaagagtaaagcaagcaaaggatacgaagagaattacttctttgttgttagacaagacggtatttattataacgaattggaaactagggtaagactgagtaagaggagacagaagattggccaggcacccagcaatacaaggctcattgttaagcacagaccaatggatgccaatgagtttaggatgcaacgctacagagagaaacaacttgaacctccgggtgaagaagacgaagaaatggaggtagaggaaacacaggaggagactcaggaagagactcaggaagggcaaggcaatgacagtcaagcagaatctgatcaggaaaaccgagaaaaagcaggaagcggaaaggaagaaggttcacgagcctcttcgagatcttccaggaaatcaaaatcccatcccgatccaattcatcagcaaagtcacgttcaagatctagatcgaaatcagcttccaaatcgaggtcccaatctagatcaaggtccaggtcaaaatctaagtcaaggtcacgttctgtatctaggtctcgatcaagatcaaagtctggctcaaaatctccgtcgagatctagatccagatctggctcaaaatctccttctagatctagatcttcatctaaagcatcgtcaagatctagatcaaagtctaggagtagatctggttctcgttcgagatctaattccaaatctccttcaagatctagatcgggttctagatctggatctgacagtgagtgaagttgaaaatatcaagagctgttacaggtgtatgatgaaatttggattacttttgaggctccctgtgaaatgcggtcacaatttgatgatagtcaatatcaaattgaaggatctgacttcccgttttaaccgtttcgctcttaataactctaaagtcttcattttttcatcacttgtatggctttccaagctttcactttggtgttttcttttgattcctttacgcgcctgttcctttgtcctagtggagctttcacagaggagtctagactgctgcaagtcactatctgaatttgatttagaattcttccctagagcagtacatctatgcatgacttgtaacggatcttctctgattttactcttcaaattggtctcgcctttcacatctgacctatctggtgccacatcgtaccaactttttttacccaatgcttcattcgtgtcctgtcccaacagcagcagcttcgtctcttcgaactcgggcaatattttctcgggtacggacgtgccatcgtttctttgg

SEQ ID NO: 878 - DNA, 254 bp, Leptinotarsa decemlineata
atattggagaatttgaaattgtagacgaccataggagtgggaagatagtagttaatttaacaggaagaatcaataaatgtggagtaatttcacctaggtttgatgtgcccattacacacattgaaaagtggacgaataatttactcccctcacgtcagtttggatatgtcgtattgactactagtggtggcattatggaccatgaagaagctagaaggaaacacttgggaggcaaaatcctcggattcttcttc

SEQ ID NO: 879 - DNA, 203 bp, Leptinotarsa decemlineata
atgtcctatctaccacctgaaaataaaaatcgtattcgtgaaataaacaattcgtttggaaaaactgaaacgagatctcaaagctcagtttatatttcgaacgatcagtgcgttcgaataactaatttcattctctttgtttcagctccaccctcttcagttgaaatattagaccactcacacaattcaaagattgaaataaa

SEQ ID NO: 880 - DNA, 782 bp, Leptinotarsa decemlineata
ttcaaagattgaaataaaagagaatcaggaatttcatttagaatgcagggtgagaaacgccaagcccgctgcgaaaatcgtctggtacagaggaaacgtggaaattaatatacctaatcgcgaagaccagaccatcgacgttccgggtaaaaacggtgacaaacgaatcacccgatacgacacccactccagagtaactctgaaaccaaccgccgaggacgactatgcggaatacacctgcgaagcaagacacgaagctctgtcgcaggatatccccatgaggaccaccgtccagctgagtgtactatatcctccgggtctgccctacatcgaaggttataccgaaggagaaacgataagaagaggacagaccgtcgaactggtgtgtagaagcagaggcggtaatcccccggcacaactgatttggtataaaaacggggaacagattcggatggcctacagaaccgctggcagagtatccgaaaacgtttatactttcacagcagatgctagtgatgacaaggcgaggtacaagtgcgaagcaagcaacgttatgtcgaagtccccgctgaaagccgagatcgatttgagtgtattattttcgccggcgcatgttaccatttctggaccaaccgaagcaagagttggagatcctgttcctctcacttgtaccactgcaaattccaatcctcccgctgaaattaaatggatggtgggtggaagacaagttcggaatgccacctccaggactgtcatgtctccggaagggggttggatcacca

SEQ ID NO: 881 - DNA, 2660 bp, Leptinotarsa decemlineata
aagggggttggatcaccacttcgaatataaccacggttgttgagccaaacaggaggagtttggttgtcatttgccatggtctcaatatgcagttgacggaaaatgtcgtgtctactcataccatcaatgttttatatcctcccagccagccattcatccacggctacacagaaggtgctcacattcctgctggtactgttcagaaaatatcctgtacatcctccgggggaaatccccttgcgacaatgacttggtacaaaaatgacaaaaagatccactccacagtgaaaacttccgaaaaatcagtcacggctgaagtaacgattttgacaaatgtcaccgacaatgaagctaggtacagatgtgaagcagcgaattccgctacagaaataccattgtttgagaccttaaccatgagcgtgtattttccccctgaccatgtgaaaatcaggcaagaaccggaggagttgaagcccaacgaagagggcatattaatttgtgattccagctccagtaatccaccagcaaagctatcttggtggcgagaaggaatacctgttcccgggttggtcaattccacaaaaccgggccttcatggtggtacagtgtccagtattgaaatgaaagtgaacgttactgaggaaatgaatgggatagtgtatacttgtcaggcaaataatgaggctctgcaaaggtctgtccacgatgctatcactcttcaagttttgtataaaccagtgtttgatactaacaacgaagaagcagtaacaggaattgaaaacgaacccctcatcatcacactgaaagccgatggaaatccccaaaatatcgcctatacatggaccaaagacgggttgccgatcacacaggctgcgtcagcaaatggcatcgaaaggattgtgtctgatggacctctactgaatatcactaaacttagtcgacacgatgctggtagctacagctgtgaagccctgaattctcaaggcagcagcttggctgtggtcaacattactgtacaatatccagcatcgatatctcaaataagtgaaaacgtgatagtgaacccaaaagaagacgccactctctcctgtactgcagatggcaatcctctggctgacgacaccattacatggaaaagagatgatttcccggaattcgctgcccgaacttcagtgatgtatgacaaaaatggcacctcttatctcaggatatcaggcgttacacgagaagatctgggtaactttttgtgtgtcgttaacaatggagtgggaaacgcaacctcgaaagaagttatgttgattgttaaacataagccagagatcgatgaacaaccacaatatttgaagtttgccactgatgctggtgatactgggaagctgatatgtagaagtagagcatctccattggcaagatatacatgggctagaaatgggactcccatcacttcaaatacgactggaaaatattacagcacatacagacaagttacttctgctcctgacacaccgacacttttaactgtcgtgaatgttacccacgacagcgttactctactatggacacccggattcgatggaggaatgaaggcggcttatagagttaggtacaggaaggttgacgatgatggatacaagtacgaagacgctgttggtagcaacgtaactacacatattgtcaaagggcttgaggtaaacacccagtatgtcttctcgattatggcgtccaataagctcggaaacagcaaatatatgccggacttgctgtcggccaaaacgtcaatgtttgttggcgatcaagttgagaaagtcataccagacgagttgctggagaaacaggatttgcccaggatagttattataagtgtttcggttgttggtgttattctcctattcataaacattggattggtagctggctgtatgctcaaaaggagagccaaaagaatcagagagcaaaataatcaaaccagcaaatctgccaccattgaaatgtatgcaccaagcagctacaacgacactgtgacaggggaaaccctttcttctgttagtgaaaaaagtgaaacctacagcaatgagggcagtcatcatgactacacagacgagagtcgcaaacctccgccaaacacctatttgatggatcatcaaccagattacccaggggcatatccagtttatgaaatgcagatgcctgtacaaactggtatcagtatggctcacaagacgcataccctgcctcatcctcatcatcaccatcaacatgatcagagacccagagcgagagatgaccaaagtctaggttaccatggtggcatgtcaggcaaatcttcttacgtgagcgcaccatctccagctccaccaaccgatgggtcgtacttcaacatgtctgaccgatacctgtcgtatccccctccactggacttccaatcagcgccacctatacctgcacatccgcacatcacacatactcacgtgccgatcacgcctccgctgccatctaacggatctctgttgcgtcaccagaggggcgttctgcctccagacgttttacacaacactagccagaacgcccaaattttacaagcccaaactctcgcccagaaacgggagctgtccagtttcggtaacggttacggcgtgaacgaacaggaaggacatcttgtg

SEQ ID NO: 882 - DNA, 1800 bp, Leptinotarsa decemlineata
ttgaaatattgtgaaatgcctactataggagttaagcgtgacttattattcaagtccttgggcaaatcatacaccgatgaagaatttcaaactctgtgttttgagtttggactagaattggatgaagttaccactgaaaaacaaataatttccaaggagcagggtgaagattcaaacctttcagcaaatgcctccgaagatattatttatagaattgatataccagcaaatcgatatgatctattatgtttagaaggtttggttcatggacttcttgtcttccaaggaaaaattccacaaccaaagtttcgagcactcaaaccagtagaaagcaatgtggaaaaactcatcataaaaccagacactgcaagaattcggccttacgcagtggctggcattttacgtaatgtaaaatttgatcaggataggtataacagtttcatagacttgcaagacaaattacacatgaacattgctcgtaaaagatctctagttgcaataggtacccatgattatgatacagttaaaggaccattctactatgatgcaaaaccccccaaggatatcaaatttattcctcttaatcaagccaaggaatatacagctgaggagttgatgactttgtattcgacacatgcccaactgaaacaatatttaccaataatcagggatagcccagtttatccagtcgtgacagatagtaatggcgtagtcttatctctacctccagttatcaatggcaaccatacaaggataacacttgagaccaaaaatgtttttatagaatgtactgctactgatttaactaaggctaaaattattattgatactctggtatgtatgttcagtgagtattgtaatgaaaaatatgaaattgagtattgcgaagttgtaaatactgacggaactgcagttttatacccagaattggattatagaacagaaataatatctgttaagaaatgcaataaaagaattggtattaatgaatctgctgaaagcatggtcaaactattatccaaaatgtgtttgagggctgaactgaccaataatcctgataatattaaagtcactataccgccaacaagacatgatgtaatacatgcttgtgatatatatgaggatgtagcaattgcttatggatataataatataaaaagaactattcccaaaactaatacgattggccagcaatttgctgtaaataaactgacagatttactgagagggccgatagcagaagctgggttcacagaagctttaactttcacattgtgttcaagagatgatatctcgaccaagttgggccttgattctattgatcaagtacctgcagttcatatctctaacccaaaaacccttgagttccaagtctgtcgaactacacttttgccaggtatcctgaaaacaatttcagctaataagaagatgcctctaccaataaaaatatttgaaatatcggatgttgtacttaaggactctgaagcagaggtaggtgccaggaatgaaagaaggatatgtgcagttaattgcaacagaactgcaggattcgaaattgttcatgggttactagataaaataatgttactcctggaggtatcatggtcccgtaagaaagattctgttggatactatttgaaagcagcaaatgatcctgcttatttcccaggaagatgtgcagaaataatctgtcatggaacaccaataggcaaaatcggtgtcttgcatcctgatgtattatctaaatttgatcttacaaatccatgttcagcccttgagataaatattcaatcttttgtt

SEQ ID NO: 883 - DNA, 678 bp, Leptinotarsa decemlineata
aaccaataattttacaattttattttagggctaagaagaccacggaaaccaaaactgtaaaggggctaccagcagttcccgaatctgtcctgaagcaccgcaaaaggcgcgaggcttcccgtgcgaagagtttacagatcgccattaaaaagaagtctgagcagatcaaaaaacgcaaagatatcttcaagagggccgaacagtatgttaaagaataccggctcaaagaaagggatgaagttaggttgatccgacaagctaaaaccagaggaaacttttacgttcccgctgaagccaagttggcattcgtaattcgtattaagggtatcaacaaagtagctcctaaagtacgcaaggttctccaattgttccggctccttcaaatcaacaatggtgtctttgtcaagctcaacaaagctaccatcaacatgctcagaatatgcgaaccttacatcacttggggataccctaacttgaaatctgtcagagaactgatttataagagaggtttcgccaaggtgaacggccaaagggtgccaatcactagcaatcaaatcatcgaagacaaattaggaaagtccgacatcatatgtgttgaagatttgatccacgaaatcttcactgtcggaagtaggttcaagaacgcttccaacttcttgtggccattcaagcttaaca

SEQ ID NO: 884 - DNA, 844 bp, Leptinotarsa decemlineata
atgagaggtcaagtggtaacaccgcagggactgggaattgttggcatcagagtctccgttgataaggaatcaaggtttggtttcactctcacaaggcaaggtggatggtttgatgtattagttaatggtggtggagcagtcacattgcagttccaaagatcacccttcaaaccgatgacaataactgtttttgtaccatggaatcaaattatagtacttcctcctgtgcatatgcagctcagcgatgatgcagacgttggtcatgtcaaaacaagctttttggccatgaatccggctctgaacttccccggcgtatcccggagcttcttcggccccgatggggggctccccaacacatgtgacgaccacgaccccgacatcctcaaccccatcataacgggaacatggctgccggaagctgtgggcggcatgcagggaaagagcgtcgtcttcgcagagacgcaaatcgtgcaggagtcgatagcgattccagggtcggacttgcacattctgtatcagagttcgcaggcaacggggtatctgagtactatttatatgaagctgacggggcctacgattcctgagagtttaactcatgtttatatcagggtggaagtggaaggttctctgcacacgaaaacatatgaagctgatcctaacctgacccatacttttgcctggagtaagcggaatatttacaaacagaaagtctacggtatcgttcaagcgaaagtctcgatcggttaccaacacagcacctgcttggagcctgtttgggagacgcaaacgactgacatcaaaggattcgatgtcgacatatcggatattggaggctggggattgg

SEQ ID NO: 885 - DNA, 3158 bp, Leptinotarsa decemlineata
ttggaggctggggattggatattcaccaccattacaactttcacgaaggtattttacaaaaaggcgacggctcgactctgcatttcaaacaatacccccgcatggtgcgggtcatcatgggaaccggcctccagagatcgctgaattgcccgggacaatgcggcgggcctgccaaagacgcgaagttgttaacaccgggatcgttggccacgggacccgatggcagcatttacgtgggcgatttcaatttggttcgccgaatcacacccgagggaaatgtagtaggaaacggcgaacgctgcatccccggagacgacagtgcctgcggggacgagggtcctgctaaatacgcccgtttggcccatcccaaaggacttgccatatcagtcgacggcaccatgtacatcgccgacggaacaaacataagggcggtggacacgaagggcatcatccacacgctgatcggcaatcacggacatcacaatcactggatacccattccttgcagaggggccatcgaggccgcccaggcgcaacttcaatggccgacaggtctagccttgagtcctttggacggttcccttcatttcgtggacgacagattaatcttgaagttaacggcagatctgaaaatcaaagtggtagcgggaacgcctctacattgccacagggaagacaacagcacgaacaacgaagatatactgggtactgttctggcgttgaccttcgcttccaatggtgatctatacatcgctgaatcagattctcacagtgtttactatgttagaactatagatacatctggtaaaataacccactttgccggcaaaatccccgacaaatcgaaaaagacctgcgaatgcccgctaaacctgaccacaaccaaccccttgggccgaaatcaagaccaatccccatcgccgacttgtgcctgcagcttcactgaggaaacaactagcaacgccgaaacgttgctggcgtccaacgcccgcttccaatcgatctcagccttggccgtctctcccggcggagtccttcacgtcgccgatcaaggatcgctgcacatattatccttggagcattacttgccgactcacgacgagaatggggagtttcgaattccttaccccgctgccggggaggtgtatgtttttaataggtacggacagcacgtggcgacgaaggacctcgcttcggacaagacgagatatactttcctctactcgaagaataccagtttcggcaaattatccacagttactgatagctccggtaataaaatccagttcttgagggattacagcaacgctgttagttccatagagaacactcaagaccacaagtcggagctgaagatcaacgggggtaccgaaacttacatttacgagtacgattggttaggaagagccacaggagtgatactgcccagcggggaaaccctgagacttggagccatgatatccagcggcggaagtctgaagatatctgtcagtgaaccatcaactgttttgagtgtgtatggaaaaagaaacaaacacgtgttgataattgacaacaaagaaattaccgaagccgtctcactcacgaactcaacagttgctctgaactccgcctacgacgccttcatgaaagtctccgccatagctcggcatcctcttctcgaagcttccttacctgtggaggctgaacttctacctgtttggtcggaacagacagtagtcttcggcgatggcattgaaaacacgatgtccacctccttcagcctcgttggtgacgtcaggaaccctcagcaaaccctctaccgggaaatctacgtgaaccgcactaaagttttgggcatcgaattcgaccagttcaccagcaaggagacattttttgatcatgacaagatgccgttgctcaccattacatatgatccggctggattaccacttctgtacaccccttacaatggagctgatccgttgaacatcacttacgacaatttcaataggatcgacagctggaaatggggggtttctgagttgaagtacagctacgacaggcatggtttgctctctgaagtaagcagccctctggatggaaccagaatatacacctacgacgacaccaacatgctgtccaagatcactttggctagccagaggagcttcactttgagctacgatgatgacgggggtctgcggcatgtaaccttgcccagcggtactaaacattccttcagtcttcaaccgaccatgggattcctgagagctacctacactcctcctggcactaccagatcctacctgcagcatttcctccattctggcaggcttctgcagaccatctttcccggagaaggagctagactggtgtatcgctactacgacaatggtagactcaaagaggtagttcatggtgatggaaagacaatgtaccagtattcagaaacttctgggctacccagtcaggtcaaccacgtagagcaagatctggaatatagatgggactaccagtttgtaggcggtttgctagtggaagaacgaatagactttggagcaaaaactggtttgagtaacgccaagttcacgtacgattacgacaacaactatagactagtaagtgtacaggggagaatcggtgggcaaaatttgccgcagaataatctggcgtacaattacaaaactggtgctctggaaacgactgggccgttcaagataatcaagccaagagtgaacgagacaaatatctatgatggcactgctctgttctcgagtaccattgactccaggttcctggaaacaagagtggctcttgtcattcatagtatggaggtgttcagaatggagtttagttacgacatgcatgggaggatttcacaaacaaggacatacacaaaaaatgttggagtgaacacttacacgaacgtgaaaaattacacttgggattgtgacggtcaacttttaggagttgaggcccaagaaccatggggcttcagatacgatgataatggaaacatgctctcattgacatacaggggaaacacaatacccatggaatacaacgttatgaacaggataatcaaattcggagaaggacaatacaaatacgacagtaggggattagttatacagaatgccagagaagaaaaattccactacaacgccaaaggattg

SEQ ID NO: 886 - DNA, 475 bp, Leptinotarsa decemlineata
tacaacgccaaaggattgctcgttcgtgcaactaagagaggcagatttgatgttcgatatttctatgaccatatggacagactttcagcgagaaaagataatttcgggaacgtcacccagtttttctacaacaatcaacaaagacctggagaagtgagccaaatatactcacccagagatggaaagctcatgtcactggtctacgacaagagaggtcatctggtatatgcccaagtataccgacataaatactacatcgctacagaccagtgtggaacgccgataatgatattcaatcagtacggagaaggtattcgagaaatcatgagatcaccctacgggcatatcgtgtacgactccaacccttatctgtacctaccaatcgatttttgtggtggaatactggatcaggtgacttccctagttcatatgacgaatggtaaggtgtatgatccgctgataggccagtggatgt

SEQ ID NO: 887 - DNA, 969 bp, Leptinotarsa decemlineata
aggccagtggatgtctcctctgtgggagaatgttctggaacggatagccaatccaacacaactccatttgtataggttcaatggaaatgatcctattaatgtcaaactcgacaggaaaagacctcaagatcctccttttggaagggggattctggtgtcgcagacagaatctggtcaagccatcgtttcaagcgttccgcctgccaacgccatctacagggatgtttatacttcagtgttcaaccgctcgcatttactgccatttacgtttgtggttcatggggctcagcaggatgccttccattttgttaaagatgagacctggaaagctaacgatgacaaagatcctccttttggaagggggattctggtgtcgcagacagaatctggtcaagccatcgtttcaagcgttccacctgccaacgccatctatagggatgtttatacttccgtgttcaaccgctcgcatttattgccattcacttttgtggttcatggggctcaacaggatgccttccattttgttaaagatgagacctggaaagctaacgatgacaaaggacaattgaaacgtctccaaggccaagtaaacactaccttccacgaaatagccagagaaaacggcagtggcaacagctacttcgatgtgaaaatccatgcacttaacgtagtcatcaacctccgatacggaacgtctgtggagaaagaaaaacagaggctgctccaccacgccaaactatcggttatccgaaaggcttggcacaaggaaaaggagtgctacaagaatggtttcgcaggcagcgtagattggagcaccagcgaattggaagaactctccaaggtcggttacgtgagtaactacgatggagagtacatccacgatgtgcagcagtatcctgagctagcggaggatccctacaacataaaattcgttcggaagcaggcagagtcgacgaagaagaggaggag

SEQ ID NO: 888 - DNA, 816 bp, Leptinotarsa decemlineata
atgcgtttctactttcaagattccggtcagaaggtagctaccaagtgcatccgtgtggcgtctgatgctactgtcgaagacgtcatcggtaccctagtagaaaaattccgtccggacatgcggatgctttcggtgccttcttatgccctttacgaattgcacgaaggatgtcctgaacggaaaatgtcgccggatgagaaaccgctgctggttcagctcaattggcacgtggacgacagagaggggcggtttttgttgaaaaacgttgacgacaagacggttggttcaatgggttcgatagattcgaatgcgagcttccgacgaaaattgtcgaaacgagagaaaaagcaactgaagaaacaggaaaaaatgtcaaggataaaattagagaacggcgataatcaagatcaagatggcgtagctgaaaagttgtataccgaattacccgaaacttcgtttactagatcgatatctaatcctgaggcagttatgaggagaagaaggcagcagaaattggagaagaaattgcaacaattccgatcaaaagatggtggaccagatacaggtggaactctcaaaatttacggagaagccctatgtaaagatgtcccttataaaactcttctgttgtcggtacgcgattgcgcaggagccgtggtacgagaaatgctcgacaaatatggtctaacaaaaacagatccgtcccaatggtgccttgtccaggttactcagcaacctggatgtccagatacagagtatgttttagatgacgatgaatgccctttgagtattttgatgacgtcaccaaatactgct

SEQ ID NO: 889 - DNA, 1095 bp, Leptinotarsa decemlineata
gaccaatcagcttcaagagcagtccaagttccacttgtcagaaatcgagctgcaggcaaaaagtcgaactacagtaccgtaacatactattgtttttttgtgtggttttatctccttagaaatggtgcgtgctctgaaatcgttaacaaaggcgttccaccaagtttcctagtgttccgaaatacgcgtagcgtcccaaaaaagagacttgggagaatggaaaacagttcacaatcatctactaaccccattcctcaggggtgtggcccaaatacccaaataaaaatacatgtgagccccaccacggggggcgacttcttcttgtgtgtagactcggacattaccatcgataatctcaaaaaactcgtctcgaaaagactgagagtgcccaggaataggatatgtttactgttcagagataagcaactgcagggcggaaatctggttcagaacggaatttcagatgggtctaggattactttattacctaatgtggaaactgggttaatggcccatcggtcggagacgagcatactgcaagctctagaatctctgaacgacacgcaagtgaacgagttcctctgcggcaaggctcccctcaacctgagcatgcgactcggcgaccacatgatggtcatccaactgcagctgagcacgatttcgtccgtcaaatcgacgtcttcgagtggtgggtctgcttcgtcgtccccctcctcctcaggtacccccacggcgggtccttctcagccgcgcccgtccagccccccgagtctcctgcaggcctcgcgcaatctccagcacacactcagaaaactgtcctccgacgttttctccgggaaagataggaggaaatcgagcgactcggccagccccgacgagcgaccggacgtgccgatctctgtggccgagccgatgcctgaggcccagccgatgtctatagacgacccgagcaccatcgaagaccagaacctgcgaacgcgcggcaagctcgaacacctgcggctcgtgatgggcaagaggcgggaacgccgccgcctacgcaggcagaaaccttactcgctacctcagagtgataccgattctcaagttaccgca

SEQ ID NO: 890 - DNA, 1040 bp, Leptinotarsa decemlineata
agatattgaagcacaaatacgagaaatccaatccaagaagaaagatgttcaggaggaacttccagataaaggagtcaaacttggtgaaagtgggtactttgacatggacatttatgaaactggaaaaggaaaatatgagggctatgttacctcaattgctgctaatgatgaagtagatgacgacgaagaggacatgggctatggccaaaaacgaactggtcttggagcacctgtggctttgttaaatgatgttgctcagagcgagaaagaatatgacccatttgcagatcgtagaaaaccgacaattgcagatagagaagatgaatatcgacagaagaggagaaggatgattatttccccagaacgtgtggatccctttgctgatggtggaaaaacgccagacttccaggcaagaaattactcacagattatgaaagaacagttgctcaaaggtgaagagaatgaggtccgtaaaaagttggtagaaaaatcaaaggatggtacgctgaaagtcataaatggtgacgtgaaacccacaacaaagaagcgaggtaggtgggatcaaactgtagatgaagctcttacaccacagaagaaaaaagccctcagcgtttctacaagtagcaatgcagcaacacctgtttgggaaggagataaaaccccagcagatattcgttgggatgaaactcctgggcataaaggcagtgaaactcctggtgcaacgccaggtcagtctacaaggatatgggatgcaacacctggagcagcaacaccaggaagagatactacaccaggccatacaggagataagagtacctcaagaagaaatcgttgggatgagacgcccaagactgaaagagaaactccaggccattcgagtggttgggccgaaacacccagaacagatagaactggggcggatcttattcaagaaactccaacaccaggagcttcaaaaagaagatcaagatgggatgagactccatcggctactccttctcaggcaatgacaccaggtgcgatgacacctactacgcccc

SEQ ID NO: 891 - DNA, 494 bp, Leptinotarsa decemlineata
atgctactcccatgctgactcctggaggatctacacctgtaggtgtgaaagctatggcaatggctactcccactccagggcatttagcctctatgactccggaacagctgcaggctttcaggtgggaaagggagatagatgaacgtaatcgaccatattcagatgacgaacttgatagcatgtttccacccgggtataaagtacttccaccaccagctggatatattcctataaggaccccatccagaaaactaacagcaacaccgactcctatgattggtggtacacctcaaggattcttcattcagcaggaagacaaatctgccaaatatcttgacaatcaacccaagggtcagaatctaccgttcatgaaacctgaagatgctcaatattttgacaagcttttggttgatgtagacgaggaagcattgagcccggaagaacagaaggaaagaaagatcatgaaacttttgctgaaaataaagaatggaaca

SEQ ID NO: 892 - DNA, 360 bp, Leptinotarsa decemlineata
tccagcaaattgccatccttatgggttgtgcaattttaccccatttgaaatcactggtagaaatcatcgaacatggtctagttgatgaacagcaaaaggtgaggactatcacagccttaggtatagctgctcttgcagaagcagccactccatacggtattgaaagtttcgactctgttctcaaacccctgtggaagggtatccgaactcatcgaggtaaaggtttggcagctttcttgaaagctattggttacttgataccccttatggacgcagaatacgccaattactacacgagggaagtgatgctgattctcattagagagtttcagtctccagacgaggaaatgaaaaagattg

SEQ ID NO: 893 - DNA, 1295 bp, Leptinotarsa decemlineata
aaaaaataatgggcaatttaggtgctgcagatattgatttcactcttgaagagcacttgaatgatggtatattgtatgctttccaagaacaaacaacagaagatgttgtgatgctgaacgggtttggaactatcgttaatcagttgggaaaacgtgtaaagccttacctgccacaaatttgtggtatgatcctttggaggttgaataacaaatcagccaaagttcgtcagcaagcagctgatctgatttctagaatagcagtcgtaatgaaaacttgccaggaggaaaggctgatgggacatttgggtgtagttctttatgaatacttaggagaagaataccctgaagttttagggtcaattctcggagctctgaaagcaattgtgaatgttataggtatgacgaaaatgacacctcctatcaaagatttgttgcctcggctaacccccattttgaaaaatagacatgaaaaggtgcaagaaaattgcatcgatttggtaggtcgtattgctgatcgtggtcccgaatatgtcaatgccagagaatggatgaggatttgttttgaattgctggaattgctgaaggctcacaaaaaagctattcgaagagcgactgtcaatacctttggttacattgccaaagctattggtcctcatgatgtgttagccacccttctaaacaatttgaaagtccaggaacgtcagaatcgtgtctgtactacagtagcaatagccattgttgccgaaacttgttctcccttcacagtacttcctgctttgatgaatgagtatcgtgttcccgagttgaatgtacagaacggagttttgaagtcgctctcattcttgtttgaatatatcggagagatgggtaaagactatatatatgctgtgacacctctgttggaggatgctcttatggacagggatttagttcataggcagacagcttgtgcggcaataaaacatatggctctaggtgtatatggttttggatgtgaggatgctctcgttcatctactgaattacgtatggcccaatattttcgaaacttcgcctcatttagtccaggcttttatggatgcgattgaaggaatgagagtggcgcttggtcccatcgagattctgcagtacacattacagggtttgttccatcctgcccgaaaggttagggatgtttattggaagatctacaattctctctacatcggcagtcaagatgctttggttgcagggtaccctagacttgccaatgatcctaaaaatcaatatatcagatatgaattagattatgtcctg

SEQ ID NO: 894 - DNA, 253 bp, Leptinotarsa decemlineata
atgtttgaagaagtcggttatcttcaagaaatttctccttcaagctacacatcaactttcatgccaaaaaccgaggtatccaatccacctcaaacctcctacgttactctgcgaacagttgtcgaaacccaagaccttcgaccggagtattctaccccaagtccagctccagttcgacataagaaatctctagccatgacatacacaagtaccggtgcagcattgagtttacctccgaagaagaaggacatct

SEQ ID NO: 895 - DNA, 303 bp, Leptinotarsa decemlineata
ctatcctggatctgagtgcttcaactacggtgtttttaccgtctcctcctcaaatacaaatccaggaacagattcaaacggtggaggttcatccagacattcacgagtctgggattcttcagccattgagagcgacaacgccaagtgagaaacctggtggtaaaacggtggcatatacttacgaagcgttctttgttagtgacggaagatcgaagaagaaacatcatccagatgaccccactgccacccttacgccaaaagccatcataaatgaaaagccgaagtacacctgcagcgagtgtg

SEQ ID NO: 896 - DNA, 254 bp, Leptinotarsa decemlineata
acacctgcagcgagtgtgggaagcaatacgctacttcaagtaacctctccaggcacaaacagacacacaggagtctggactcgcaatctgccaagaagtgtataacttgcggtaaggcttacgtaagcatgccagcgcttgcaatgcatgtgctgacccacaagttggcgcaccgttgtggagtgtgtggcaagcaattttcgaggccttggcttctacaaggccatctccgatcgcacactggtgaaaaacct

SEQ ID NO: 897 - DNA, 751 bp, Leptinotarsa decemlineata
atggctaggtacggacagagaccggaaaatgcgctcaaacgagctaatgaattcatcgaagttggaaagccagctagggctctcgataccctacaagaagtctttcggaacaagaaatgggcatacaactggtcagaatcggtcttggaaccgatcatgttcaagtacttggaactctgtgtggacctaaggaagtcccacattgccaaagaggggctcttccaataccggaacatgttccagtcggtcaatgttggttccttggagaatgtaataaggggatacctgagaatggctgaggagagaacagaaaacgctagggaacagtcggcacaagctgtcatcgacatcgatgatctcgacaacttagcaactccagaaagtattctgttgagtgctgtttctggagaggatgctcaggatcgctcagaccgtacaattctaactccatgggtcaaattcctatgggaatcttattgtcagtgtttagaactgctcagaaccaacgctcacgtcgaaaatctctaccacgacattgccagaatggctttccagttctgtcttaaatacaacaggaaaactgagtttaggaaattgtgcgacaaacttcgtaagcatctggaggacatttgcaaattgcctacgcagacagcaaacgtttccatgagtaaacctgaaacacagcagctgaatcttgaaacgaggcttaatcagctggatttcgctattcaaatggaattgtggcaggaag

SEQ ID NO: 898 - DNA, 639 bp, Leptinotarsa decemlineata
tggaattgtggcaggaagcttataaggctattgaggatatccacagcttgatgaatctttcgaagaagtccccagtcccgaaaaccatggcgaactattaccaaaaactggccatggttttctggaaagctggaaactacttgttccatgccgctgctttatttaaactgttccagttgtccaaggaaatgaaaaagaacattaccgcagaggaactccaaagaatggcatgtcgatctcctttggaaaaagcgcagcgtttagccgttcttctcggcttattccagcctcccactagggcaagtcttctcaaggatctggtacgtgtcaacgttgtgaacttagccagcccgcagctccaggacctctacaattggctcgaagtagagttccaccctctactgttgtgcaagcgtgtgcacgatgtgataaactctcttgaggcagaagaaaactcggccctgcagcagtacattggcgccctgcaagacgtcacgctggtccgtctcgtcaggcagatcgcgcaggtgtaccagaccattgagtttgccagacttctggatatcgcgaagttcacgacgcctttccatctggagcgcttgctcgtagattgcgtccggcacaatgacatgcagattc

SEQ ID NO: 899 - DNA, 1985 bp, Leptinotarsa decemlineata
acaatgacatgcagattcggattgatcacggtaagaggtgcatccactttggtatggatttgagcgagagtcaacgggaggataagccggaagggccgacactgcaagtcatgcctagcgagcaggttcggaatcagttggtaaacatgtcaactgtgctgaatcaggctatacaagtcatcaatccgaatagaaagaagcttgagagggagaaattgagggccgcaatggtccagaactaccacgagacgaaggtgagagagcaccagaagatcctccagagacacaagatcatcgaggacaggaaagagtacatagagaggttgaatacagtgcgggaagaagaggaacagaagaggttggaggaagttcagaggcagcacgtgcttgctgagcataaacggttggagcaggagcgagaggaaagggagagaaagagggctctgaacgaaatccagcagatcaaggacaggcacctgaaggagaagctacagcagatcagccagacgggacatggacaaaagatcttgaagaaactggacgaggatgacatcaagaaactagacgctgatcaaatagcggccaaggaagcggaagagcttcagaaagagcgccgcgagctccaagcgaaactgaagtctcaagagaagaaggtcgactatttcgagcgagctaaacgtctcgaggagatccctctcctgcaggcgagccagaaagagcgccagctgcaggaccagaacttctgggaactgcaagagaaggagcgcatcgcggctgcagtcgaagaacgcaaactcgccgtcgctacacgtgaccgcctcgtccggatgaagcccgacaaggacgagttcctcgcgaagctcaagaaggaacgcaatattgtgttcgaggacaagcttagagaattcgaagaggcgctcgccgccgagaagaagaggcgtctgctcgagcgtcgcgctgctcgcaaagaggaacgccgcgccaagtacctcaagcaaaaggaggaggaagcggagcgcaaggcggccgagcagcgacagcgagaggaggaggagcgcctgcggcttgaggaggaggcacgccgcgagcgcgaggagaaagagcggatacagcgggaggaagctgagcgtaaggagaaggagcgcaaggagatgctcgacagggcagcggctctgcagagggccaaagaggaagatatcgaacgcaagatggaggaggaaagggagagggcaagagagaggtcaaaagatacctggagagacaaggatgccggtacgaaaacagaatcaggaccctggcggagaggaatggaccgaggcggaggagccagcgaggaacccaagagaacggaagcttggaaaccttctcgttctcgcgcggacgaccaatctagaggcgccacagatagctggagagggggcgaagataaaaaagatgatcgcccaatcagaaggaccttcgatagagacaccagggataggtatggagacagtcgcttctcgcgagatggcaggaccggtcgagacgataggggtgggagagatgatggtttgcggcgcaatgacgacaataacttccgtcgtgctgatgatagggaccgcaggggggatgatagggatcgtagaggcgatgatagggatcggagaggggatgatagggatcgtagaggcgatgatagggatcgcagaggggatgatagggatcgtagaggcgatgacagagatcgaagaggaggcgatgatggtggtagctcttggcgtagtgcaaggaagatggacgacgaaccgccaagtcgtagaccgccgccttctagaacagctccttcagataatgtatggagatccaatagagacagagacacagaccgtaaagatgaaccgcggagaggagcgcctgcacccgctaaagaaagacctgttcgtgaaccagctccgccgcagcaggaaggagaagatggctggtctcaagtttccggaagacgtcgt

SEQ ID NO: 900 - DNA, 459 bp, Leptinotarsa decemlineata
atggatgccaagccccgggaactgtatttattatttagagcttatgagggttatgaaggatcgttactcaaagttacgagtaaaaatggcaaaacagcatcgcctgtggggttcgtgacttttaacacaagggcaggagcggaagcggctaaacaggacttgcagcagggcgtaaggtttgaccccgacatgccacagaccatcagattggagtttgctaaaagtaacacgaaggttagcaagcccaaacaacaagctgctaacgccgccaacacgcacccaactttgatgcaccccctcaccggacacctggggacgccgttctttcccggcgctcccgagctatggcaccatcctctggcgtactccgcggccgctgaactacctggggcagctcttcagcacgccacgctagtccatccggcgcttcatccccaggtgcctgtaaggtcttacctt

SEQ ID NO: 901 - DNA, 488 bp, Leptinotarsa decemlineata
atggcgtccgacggtgaagatgttatcacagaccaagaaaaagttaaaatagtatcggatttcattctccattcgccgcctggcgaatttaatgaagtctttaacgacgtacgaaaactcctcaataatgacgacctactaaaggagggcgccagcggggcattcgcccagtacaacaaagaccaactgaccccagtgaaaatagaaaactccgataacttagtgctcatcaccgaatacaacgatcagggaaacaacagatttttcgacccgcgaagcaggcagagctttaagtatgaccacctgcgaaaagaggcctccgactaccagacgtacaccccggatccagcggcggagccctggcgctccgctctcgacgctgagttcatccagtacaccaggaatcattaccgggacggggtgtgcagtgtggtgggcaggaaccaagggggcaacgtggtcttgacagtttgcatcgaagaccacca

SEQ ID NO: 902 - DNA, 248 bp, Leptinotarsa decemlineata
aagaccaccagttccagccaaagaacttctggaacggcaggtggaggtcgcagtggtcgatctctctgaatggaggatccgtggcagaagttagaggtgtgttgaaggtgcaggtacactactacgaggaaggcaatgtccagctggttagcacgaaggaaatcaaagagtcagtagtggtaacgaacgaggctcaaacggcaaaggaaatagtccaggttgttatgatttatggattttcactaata

SEQ ID NO: 903 - DNA, 400 bp, Leptinotarsa decemlineata
atggaggcatacgatgtaattgtgaatcaacccgttgtaattgataatggaactggtgtgattaaagcaggcttcgcgggcggtcaaatcccaaaatgcagattcccaaattatgttggtcgaccaaaacacacccgggtgatggcaggtgccttagaaggggatttatttataggaccaaaagcagaagaacataggggtttgttatctattaagtatccaatggagcacggcattgttacagattggaatgacatggaaaaaatttggaattacatttatagtaaagaccagttatctacgttttctgaagaacatccagtactattaacagaagctcctttgaatcccagaccaaacagagaaaaagcagccgaaataatgtttgaaaccttcaatg

SEQ ID NO: 904 - DNA, 739 bp, Leptinotarsa decemlineata
aaccttcaatgtccctgccttatttatctctatgcaagctgtactcagcttatattccactggtcgtacaactggtgttgttcttgactccggcgatggtgttactcattctgtacccatttacgagggctttgcattaccacacagtattatgagatctgatattgcaggaagggatgttactagatatttaaggttacttcttcgaaaagaaggcattattttccgaaccacagcagaatttgaatctgtgaggaatttgaaagaaaaggcatgctacctttcaaacaatccaattaaagaagaatcagtagaatctgaacaaataaattatactcttccagatggtacggctataaaagttggaccagcaagatttagagctccagagattctttttaaaccggatataataggagaagaatttgaagggctacatgaagttctaatgttttctattcagaaatcagatttagatcttagaaaagttctgttcaagaatattgtcctatctggcggatcaacattattcaagggctttggagacagactattgtcagaaattaaaagaatgtctccaaaagaaactgcaataaagatatccgcaccacaagaacggttatattcaacttggataggaggatcaattttagcatcacttgacacctttaaaaaaatgtgggtttcgaaaagagaatttgatgaagagggtcaaagagctatacatcgaaagacattt

SEQ ID NO: 905 - DNA, 864 bp, Leptinotarsa decemlineata
ttggtgatgagagctagcgataatattttccacttacggtgttttgtgtgcgttgtgtgtggaatacgactacaaaaaggagatttgtacgtcatcaaacagggacaattgttctgcagagctgattatgaaaaagaagtggagatgatgcaaggatttggttatggagaattcatttgcgatgaacttataccatccagcagatctcacgatggtcgaagaggaccaaaaaggccaagaacaattttgactactcaacaaaggagagccttcaaagcttcttttgaagttagctccaaaccttgtaggaaagtaagagaaactctggcaaaggacacaggattgagcgttcgaatagttcaggtttggttccaaaatcaacgcgctaaaatgaagaaaattcaaaagaaagccaagctggataacaaagcgcccaaagacctggaaaatgatgaaaagaaattaaatgtcaaagaagaggaacaaagtccccgttcaaccccgttcttcaacgacagctgcagcgacaatgaaaccacaaccgacgaaactattctccagaacactcccaacccccattttctcaacataaaggaagaactcgagaacgataactccttcttcaaaagcaataacaacatgccgctacacgcttttacaggaatagaagttaacaaaagacgagaggaaggctacatgggcatatcgtttcctgcaaacttagaaacggcacaacagactttgttcctgaatccaccaatggcacatcagaatcctcctcaaacgacgtcaggactgaatccgatcgatcgactgtactccatgcagaactcgtatttttgcgaagaggaacaaatggaaccg

SEQ ID NO: 906 - DNA, 681 bp, Leptinotarsa decemlineata
atgttcctaacaagaagtgaatatgaccgaggggttaatacgttctctcctgaaggacgtttattccaagtggaatatgctattgaagccattaaattgggttctacagctattggaatatgcaccagcgaaggagtcgttttagctgttgagaaacgtataacatccccgttgatggaacctactacaatcgagaaaatagtcgaagtcgacaagcacatcggttgcgcagtgtctggccttatggcagattctcgaacaatgatagacagagcccgtgtagaatgccagaaccattggtttgtctacaatgagaacatgagtgtagagtcatgcgcccaaggtgtgtccaacttggctattcagtttggggattctgatgatgacggagcggctatgtctagaccatttggtgttgccattttattcgctggtattgatgagaagggacctcagctgtaccacatggacccatctggagactatgcggaagttttatacaaatttataacttctgtcatatttgagaaaagtaggaggtcatcaaaagttcactatttcaatttcgttttgaattatgagggtaatatttgtgtgtcagacatattttttaattatttgcattggcaccattatatcctagtggatgagtttattattgaaggaaatacattgtttcct

SEQ ID NO: 907 - DNA, 301 bp, Leptinotarsa decemlineata
ctgaaaatggctacatacgaagagtatatccagcaaaacgaagacagagacgggatacggttcacatggaacgtctggccgtccagcagaatagaagccacccgtttggtggtgcccttggcctgtctttaccaacccctgaaagaacgtcccgatcttccaccaattcagtacgatccagtgctgtgcactagaaacaattgtcgtgcaatactgaacccactctgccaagtagattatcgtgccaagctttgggtgtgcaacttctgctttcagcggaacccgtttccccctcaatatg

SEQ ID NO: 908 - DNA, 1617 bp, Leptinotarsa decemlineata
cgtttccccctcaatatgccgccatttccgagcaacaccaaccagctgagcttatgccaatgttttccaccatagagtacactattacaagagcacagtgtttacccccgatatatctctatgttgtcgacacttgcatggatgaggaagaattgggttcactcaaggactccttgcaaatgtctttgagcttgttgcccccgaacgccttgataggattgattaccttcgggaagatggtccaagtgcacgaactaggtaccgagggttgcagcaaatcttacgttttccgaggtacgaaagacctcacagctaagcaagttcaagagatgttgggagtgggcagagccgcagtaagtgctcaacctgctcctcaacaaccaggacaacccatgaggcctggagcactccagcaagctcctacgccaccaggaagcaggttccttcaacccatctcgaaatgcgacatgaacctcactgatcttattggagagttgcaaagagacccatggcctgtccaccaaggcaaacgcgccctcagatcgaccgggacagctttatcgatagccattggcttgttggaatgcacatacgccaatactggtgccagggtcatgctattcgttggaggaccttgctctcaaggccctggtcaagtcttgaatgatgatctgaagcaacctatcagatctcaccacgacatccaaaaagacaatgccaaatacatgaagaaagcaatcaagcactatgataatttagcgatgagggcagcaacgaatggccattgcgtcgacatatattcatgcgctttggatcagacaggattgatggagatgaaacagtgttgcaattcaacagggggacatatggtcatgggcgactcgtttaattcttccctgttcaagcaaacgttccagcgtatattttcgaaagatcagaaaaacgagctgaagatggcatttaatggtactctggaggtcaagtgttccagggagttgaaaattcaaggcggtattggatcttgtgtttcgttgaatgtgaagaatcctttggtttccgacaccgaaataggaatgggtaacacggttcagtggaaaatgtgtacggtaactccaagtactaccatggccttgttcttcgaggtcgtcaaccaacattccgctcccatacctcaagggggaaggggctgcatacagttcatcacgcaatatcagcatgctagtggtcagaagaggatccgagtaacgacagttgctagaaactgggccgatgcttctgctaatatacatcatgtcagtgctggattcgatcaagaggcagccgcagtgataatggcgaggatggcagtttacagagccgaatcggacgatagccctgatgtcttaagatgggtcgatagaatgttgatacgtctgtgccagaaattcggcgaatataacaaggacgacccgaattcgttccgcttgggcgaaaacttcagcctctacccgcagttcatgtaccatttgagaaggtcacagttcctacaggtgttcaacaattctcccgacgaaacgtccttctacaggcacatgcttatgcgtgaagacctcacgcagtcgctgatcatgatccagc

SEQ ID NO: 909 - DNA, 222 bp, Leptinotarsa decemlineata
cgctgatcatgatccagccgatactctacagctacagtttcaatggaccaccggaacctgtgcttttggatacgagttccatccagcccgacaaaattctgctcatggacacgttcttccagattctgatattccatggcgagacaatagcccaatggcgtaacctcaaatatcaggacatgcctgaatacgagaactttagacagctgctgcaagccccag

SEQ ID NO: 910 - DNA, 247 bp, Leptinotarsa decemlineata
gctgctgcaagccccagtggacgatgcccaggaaattcttcaaaccaggtttcctatgccgcgttacatcgatacggaacaaggaggatcacaggctagattcttgctctcgaaagtcaacccgagtcagactcacaacaatatgtacgcctacggaggggacggaggtgctccagttctcactgatgatgtatcgttacaagtattcatggatcacctgaaaaaactggcagtgtcctctacggct

SEQ ID NO: 911 - DNA, 415 bp, Leptinotarsa decemlineata
ccccccagccttcttcctgcgggcctcggagaggtaccagcgaaccccaaagtgcgccaggtgccgcaaccacggcgtcgtctcggccctcaagggtcacaagaggtactgccggtggagggactgcaactgtgccaaatgcaccctcatagcggagaggcagagggtgatggcagcccaggtggccctaaggaggcagcaggctcaagaggagaatgaggctagggagttggggatcctctttccggctcctgtgcctcaggcagcttcggaggctccagctccaagtccgtcggtaactgctccagctgatgtgggaatgtcgcctttgatgcagaggagttcgttcactactgcgtctgattcgtcggaagcgtctagtccaagtaagtccagatttcatattccacagaaa

SEQ ID NO: 912 - DNA, 448 bp, Leptinotarsa decemlineata
atgaatactctatcacaggaactataccatcagagctactcccgcgttggagttgtttttgcgtctatcacaaactatcacgaattctacaccgaacttgatggtaacaaccaaggcgtggagtgtttaaggttactcaatgaaataatcgctgattttgatgatctgctgtctgaagaaaggttcaaagccatcgataaaattaaaactgttggttcgacttatatggctgccgttggattaatgcctgacttgagaatacttgatgacgatgaaacgacggcgggaacgcatttgagcacgctggtagaatttgtatttgccatgagggataggctactgaacatcaatgagaactcctacaacaacttcatgttgagagttggcataaacataggacctgtcgtggcaggagtgataggtgcgagaaaacctcaatatgatattt

SEQ ID NO: 913 - DNA, 597 bp, Leptinotarsa decemlineata
atgtggccagccgaatggattccactggtttaccaaatcacacccaagtaacagaagaagtcttccaagtactcagatcatatccgtatgagttccaatgtagaggcaaagtgaaagttaaaggaaagggagatatgacgacatatttcttgactgacaggaagcaaccagggactcttagagtggaagaattaaatagtttaagatccaacgccaacaacaaacataacccgctacaaaatcgcccgccggttcgggaagaatcttatacgacttcccgaaacgctgtacgtcttcctcctcttcgagaaaccgcttcacatataaatggttgtgaaaacgaaccacttctaccaaatattcggaatggcaagaaaaaatgtttgccggctgaagaaacgttacctccccctcctttaccaccccataaaaacaattgtcaaaggcaaggaactccagaaatgaaatacaacccgccttggccaagaggacaagttgatagtgtcaaaccataccttaaacctttaccaaaacctccaggaaaagaatcgcccaatcgacaacacagaaaacatcaaccagcaccagtacctcctc

SEQ ID NO: 914 - DNA, 216 bp, Leptinotarsa decemlineata
cagcaccagtacctcctcctcatcaaaatcaacgtgcgccggaccaaacagcggagcttctgcgcaacataatccagacgagacacaatcccttacttcagagtagacaaagcccacatcatcatagacatagtcctctccagcgacatttttctgatgaaagcttagggggactctataataccggattaccgcaaagaattcattcatcggcag

SEQ ID NO: 915 - DNA, 1012 bp, Leptinotarsa decemlineata
gaattcattcatcggcagatgaaatcagttccttgaatcattcgcctagtatcagtagttctgatgagagctatagcagaacaaccgacgctgacgccagcccttgcgtatcgcctcccttacctactgatacccagcaatttctgtttccttcggatatacaagtcaacccattatcttctccagaagtatcaccccgagcctctttagattatattccaccaaactgttctttgcgcaacaatgttgagccgaaaagaaataatttagcaccaaatgcgttactcgctttagctggtacttgtaacactgtcgattcttctgtagtaacgagtcctcctattttagatggtgaagacagttgtcgaggggaaagttgcgcaagtttcgaatttgtcacgaaacctacatccctcttacgaactactagcgctaacggtgcaaaatgtgccaaagcttctaaaaaaattctcaatttggacaaacatcggatacgaaacgatagtgattcgattctagagtgtaacaaattatcctcaaactgtaagaggtcacctagtttcaaagaggccgatgaaatcaggcagttgttgaaggaggaagataataagactacaatcagcagtgaaaaaagttccagaaaggatggttgttgccaaactgacaaaaaagacttgaggcaaatgcgactgagtccaatcggcattcgagaaaaactctcaccgaataataagatcagcaatattcctttcgaacgagaaatacagatgctactggacgaacagaatttgctgcagaacatccccccaaagttggaactcaaagaccttgcactggagccactcgtaaggtacgcaccaaataacaacaaccaccaggtggggctggcggcaattcaagcgcttgctctcggttttcggggcaacaatgttaacaacctgcagtgcatgtccccttcccctcgagcaagcagcaaagaaggatcgcttaagagggggccttctccaggacc

SEQ ID NO: 916 - DNA, 626 bp, Leptinotarsa decemlineata
atggagaatactcgagtcactattgaagaagttgctgagggggtcggcatatcggttggctcatgcaattttttcggaaattttggacatgaagcgtgtgacagcgaactatttcaaagatgcttaatgaagattctgaatatcgaattgtggaagttgtatcttacttatgttaaagaaactaaagcttctctgccaacgtacaaagaaaagatggctcaggcttatgattttgcgctagatcgtataggaatggatatccactcctactctatatggaatgattatgtaaactttttgaaaggagtggaagctgttggttcatacgcagaaaatcaaaaaatatcagcagttcgaaaagtttatcagagaggtataattaccccaatgacaggcatggagacgttttggaaagattatattgcgtttgaacagaatattaatgctattattgctgaaaaaatgagcattgaacgaagcagggattacatgaatgctagaagggttgcgaaagaacttgaagtacagatacgcggtataaatagaaatgcaccaagtattcctcctggtggtgctcaagaagaaagaaaacaggtcgagctttggcaaaaatacattgcatggga

SEQ ID NO: 917 - DNA, 937 bp, Leptinotarsa decemlineata
aaaatacattgcatgggaaaaaagtaatcctttgcgtacagaagacacagccttgctcactaaaagagtagtatttgctcttgagcagtgcttattatgtcttggacatcacccagacatatggtatcaagctgcacagttcttagaatacagttgcaaaattttagctgaaaagggggatgtgaatgcctcaaaattgttcagtgaagaggcagctaatatgttcgaaagagccaccagcactttattgagtaaaaatatgctgttatactttgcttatgcagactacgaggaaggaagactgaaatatgaaaaagtacaccaaatttattctaaatatttggaaatcaaggatatcgatcctacactggcatacattcagtacatgaagtttgcaagacgagcagaaggaatcaaatcagccagagcagtctttaaaaaggccagagaagacaaccgttccaaataccatttgtttgtctgcgccgctcttatggagtactactgcagtaaagacaaaaacattgcttttaggattttcgaacttggactgaaaaaatttggagctattcctgagtacattacttgctacatagactatttgtctcacttgaatgaagataacaatacgagggttttgtttgaaagagttctatcatccggaagtttagaaccagaaaagtctgtctgtatcgtttcaaagtgcgatccctcaatgttacaaggtatctcaaaatacatcattgaaaacaaacatggcgtcgaagtgtacagggtgcgtcaaaatacatcatttaagaaaaaacataacagttccacgaggctgcaagttttcaacgtgcgttccctcaatgtgtacaaggtatctcaaaatacatcattgaaaaacaaatatgacgtcgaagtgtacagggtgcgtcaaaatatatcatttaag

SEQ ID NO: 918 - DNA, 210 bp, Leptinotarsa decemlineata
atgtactcaacaaatgggaatgacgaggccaaagataatcacaatcagcaaattgagcgagcagaaattgcaaatctggtgagatcgagaatggagagtttgaacttgccaaccatcgattataatgatgttagtgaaaaacgaaatagtttatcatatgtgatcatcaacccaagttgtgatctgaaattggaggagggtgacataatg

SEQ ID NO: 919 - DNA, 1330 bp, Leptinotarsa decemlineata
atgttttgtcaattaagagacttctggagactgctgcaatggcctaaatctcattccatactattactgtcgcagctcttggactgcatctgttctgcagcgctgctctacgcagacatcacatatcagagcctcatggagacaggctacttcgacaggcttggcccattcaggataagcgacgagatgtgcattgcttccaacaatttagaatatgtttacaaattcatttcgcttctagaaaactactttgatttcgtgactttggagtctatcgcgtcggaaatccaatttgcgacgttaacgaaccaattagacagcactttgagccagctacaggtgaggatacgcgacatactgaagagaatcggaccgcagatgcaagaggcattgaggaaagcaatgtttcacgtagcgtggtcgccagacacgttgccgacaaatcaagcggtggcgcctcttttcgactatttgcatggacatcttcaagccctcaacataaatctgctacctcaaaatttccaaaaagttcttcaagagatatgggaatacacactggccgagctgaaccaccagatggacagcggagccaacagcgacgaaattccccccatgttccacgagaagctccactccgccctggagctcatggtggagttcttccacgcggacggacaggctttgaccatgcaagttctgcactcgcccgcctacagacaaatagagcaaagactgcaataccacaggaccgataccgaaacactgatggagatcttttacggacaacggctgcaggaccagctcaacacatctaccagcccgtatggtgtgctggccgtcagggcgtacttcaaccacgattcgctttgcgtcgaggtcctgcatgcccgcgacatcatccctctggacccgaacggcttcagcgaccccttcgtgatcatcgagctgctgccgcaccgtatattcccgcactgcaatgaccagcagacgaacgtccacaaaaagacgctccaccccatcttcgacgagtgcttcgagttcagcgtgtcgctggaccaatgtcggtaccccggcactatgatcggcttcacggtcatggaccacgacgtgctcacggctaacgactttgcgggtgaagccttcctcgcgctagggagcattccgggtgtcgcggacgcggggtccggcgtcgacaacttccatggcctcaaaccagtagagctcgtcctcatgcagcagcaccagaggaatcatcccatactgcaaatactggaatccagggtgggtgatcgtgtggctgcggacttcgttaaaaagcagaagcagagat

SEQ ID NO: 920 - DNA, 484 bp, Leptinotarsa decemlineata
atgtcgtctactctagaagataaagctatctgggaagatggggaagaatcattgggggaggaagttctgaggatgtcgactgatgaaatagtcagccggacgcgtttactcgataatgaaatcaaaataatgaagagcgaagtaatgagaataaaccatgaactccaagcccaaaacgaaaaaatcaaagaaaacactgaaaagataaaggtaaataaaacgctaccttacttggtatctaatgttatagaactgctagatgtggaccctcaagaggaagaagaagacggggcagttgtagacttggattctcaaagaaagggaaaatgtgccgttgtaaaaacatctactcgtcaaacatattttctaccagtaatcgggctcgttgatgaagaaaagctcaaacctggagatttagtgggtgtgaacaaagattcttatcttatcctagaaacattaccagcggagtatgatgcaagagtaa

SEQ ID NO: 921 - DNA, 397 bp, Leptinotarsa decemlineata
ggaactggaaaaactttgttggctagagcatgtgctgctcagacaaaatcaacatttttgaaactagctggaccccaattagttcagatgttcataggagatggtgctaaacttgtaagagatgcttttgcgttagccaaggaaaaggcaccagctataattttcatcgatgaattggatgctattggtacgaaacgttttgattctgagaaggctggtgatcgtgaagtacaacgtacaatgttggagcttttgaatcagttggatggttttagttcaacagctgatataaaagtaattgcagctaccaatcgagttgatatcttagatcctgctttacttcgatcaggtcggttagatcgtaaaatagaatttcctcatccaaatgaagaagcta

SEQ ID NO: 922 - DNA, 248 bp, Leptinotarsa decemlineata
caaatgaagaagctagagcaagaataatgcaaattcactcaagaaaaatgactgttaacccagatgtaaactttgaagaattggctagatccactgatgacttcaacggtgctcagtgtaaagcagtttgtgttgaagcaggtatgatagctttgagaagaaatgccactgctgttacccatgaagattatatggatgctattatggaagttcaagccaagaaaaaagcgaatcttaattattatgct

SEQ ID NO: 923 - DNA, 363 bp, Leptinotarsa decemlineata
tggcggtgggtaaaaataaaggtctttctaaaggtggcaagaaaggagtgaaaaagaagattgtagacccgttcacaagaaaagattggtatgatgtcaaggccccgtcaatgtttgccacccgacaggttggcaaaaccttggtaaaccgtacccaaggtaccaagattgcctctgaaggtttgaaatccagagtgtttgaagtatcccttgctgacttgcaaaacgataatgatgctgaacgctccttcaggaagttccgtcttattgctgaggatgtgcagggtagaaatgtattgaccaatttccatggcatggatttgactactgataaactgaggtcaatggtcaaaaaatggcaga

SEQ ID NO: 924 - DNA, 458 bp, Leptinotarsa decemlineata
tggtcaaaaaatggcagacgttgattgaagcttcagctgatgtcaaaacatctgatggatacctgttacgagtattttgtattggttttacaaacaaagaccaattgtctcagagaaaaacttgctatgctcagcatacacaagttagggctatccgtaagaaaatggttgaaaaaattatcgctgaaattcaaaagtctgacttgaaaggagttgtaaataaacttcttcctgacagtatagctaaggatattgagaaagcctgccagggtatctatcctcttcacgacgtatacatccgtaaagtgaaagttctgaagaaaccccgtttcgaactgtccaagctcttggagttgcatggtgatggcggtaaaggaggatctggtgaacccggtggtgatgctggctctaaagttgataggcctgaaggttatgaaccaccagtacaagaaaacgtt

SEQ ID NO: 925 - DNA, 640 bp, Leptinotarsa decemlineata
atgaactgtggactttctacaatgggcgaaggaaatggaatcatcgagcatcacgacatccacggttccctgttgcccatcaacggcagccattcgggttcgtcgggtcgcagcacgcccaatacttccaatgaccccgcgcccggcaaattattcgtcggcggattgagctggcagacgtccagcgagaagctgaaggaatattttgggatgttcggcaacgtcacggacgttctcattatgaaagatcccgtcactcagcggagccgtggatttggtttcatcacgttctcggaaccttccagtgtagataatgttctgaaagttcccatccatacattagatggaaagaagatagatcccaaacatgccaccccaaaaaaccgaccaaagcaacccaacaaaacaaagaagatatttgttggaggggtgagtcaggacacatctgctgaagaagtgaaagcttatttcagtaattatggtaaagtggaagaaacagttatgctcatggaccagcaaaccaaaagacatcggggattcggtttcgtgacttttgaaaacgaggacatagttgatcgcgtgtgcgagattcatttccacacaataaaaaacaagaaagttgaatgcaagaaagcacagc

SEQ ID NO: 926 - DNA, 458 bp, Leptinotarsa decemlineata
aatgcaagaaagcacagcctaaagaggcggtacaagccaacgctcagttactcggcaaaagattaatgttgagcggtctaggcatgcgtatggctgctccagctcccggagccatagctgtcaatcctctggccacaatgcaagcccaggttcatctacaggcggccgcatctgcgaccgcagcagcccaagcacagtcagctgctgtggctggttacggcaagctttttggagcttaccctcacttggccagctatcgttactctccataccccatgaccgccgttagtgccgctcccgggacagcagcaccccctgcccaagctccaggcacagcccaagctttggcaccacctgtagcagccagtccgtatcagggttataacctcacaaatgtcgacatgtcaacgttccaaggcgtcgattggggctccatgtacggtgtaggcatgtacgtt

SEQ ID NO: 927 - DNA, 856 bp, Leptinotarsa decemlineata
atggtgttagcagatttgggtcgtaaaataacgactgctttgcagtccctcagcaaggcgacaattatcaacgaggaggtcctgaatggaatgctcaaagatatatgtctagctctcatagaagccgatgtaaatattagattagtcaaatctctccgagaaaatgtaaagtctgttattgattttgaggaaatggctggaggcctaaataaacgacgtatgatacaaagcgcagtattcaaggaacttgtcaaacttgtagatcccaatgtaaaaccgtatcagccagtcaagggaaaacccaatgttattatgtttgttggtttacaagggtctggaaaaacaacaacctgtacaaaattagcatatcattatcagaaaaagaactggaaatcttgtcttgtctgtgcggatactttccgagcaggagcgtatgaccaagttaagcagaattgcaccaaggctagaataccattttatggaagttacacagaagttgaccctgttgttattgctcaagatggtgtagacatgtttaaaaaagaaggttttgaaattataattgttgatacaagtggtcgacacaaacaagaagaatcattatttgaagaaatgttagcagtttctaacgctgtgaaacctgacaatatcattttcgtcatggatgccactattggtcaagcttgcgaatctcaagctaaagctttcaaacaaaaagttgatgttggttcagtaataatcacaaaattagatggacacgccaaaggtggaggagccctcagtgcggttgcagctacaaatagtcctatcatatttattggtactggagaacacattgatgatctagaacctttca

SEQ ID NO: 928 - DNA, 367 bp, Leptinotarsa decemlineata
tcagtcaagattttatgtcaaaaggcagtgaacaggaatcaatgaacagattaaagaggttgatgacaattatggatagtatgaatgatggagaattggataacagagatggtgctaagttattcactaaacagaacggtagggtcacaagagttgcacaaggatcaggagtaacagaaagggaagtaaaagaactgatcgctcaatacacgaagtttgctgctgtggtgaagaaaatgggtggtattaaaggactcttcaaaggaggtgatatggctaaaaacgtcaatcacaaccaaatggccaaacttaatcaacagatggccaagatgatggatcccagagtattacatcaaatgggaggtat

SEQ ID NO: 929 - DNA, 597 bp, Leptinotarsa decemlineata
taacaaaacaatatgataagtccgaaaatgacttgaaagctctccaaagtatgggacagattgtgggtgaggtattgaaacaactgacagaggaaaaatttattgttaaagctactaacggtccccgctacgttgttggctgtcgaagacaattagataaagctaaattgaaagcagggacaagagtagctttagatatgacaacattaactattatgcgctatctgccccgagaagtggaccccttggtttataacatgagccatgaagatccaggagacgtcacttattctgctattggaggtctctctgaacaaattcgggaattaagagaggttattgaactgcctctgctgaatcctgaactatttatgagggttggaatcacacctccaaagggttgccttttatatggacccccaggaactggaaaaactcttcttgctagggctgtagcctctcaattagatgcaaatttcttgaaagttgtttccagtgcaattgttgataaatacattggagaatctgctagattgataagagaaatgtttaattacgctaaagatcaccaaccttgtatcatttttatggatgaaa

SEQ ID NO: 930 - DNA, 476 bp, Leptinotarsa decemlineata
ttatggatgaaattgatgccataggtggccgcaggttttctgagggaacttcagctgacagagaaattcaaagaaccctgatggaacttctaaatcagatggacggatttgattcattgggacaggtaaaaatgataatggccactaataggcctgatacattggatcctgctttgctccgcccaggtcgtttggatagaaaaattgagatacctctaccaaacgagcaagcaagacttgaaattcttaaaattcatgctttgcccatcgccaaacatggtgaaattgactacgaggcaattgtcaagctatctgactccttcaatggagcagatttgagaaatgtgtgtacagaagcagggttgtttgcaatccgggcagaaagagaatatgtgattcaggaagatttcatgaaggcagtgagaaaagttgcagataacaagaaattagaaagtaaattagattacaaacctgta

SEQ ID NO: 931 - DNA, 870 bp, Leptinotarsa decemlineata
atgtgtagcaacgaaagttcgtccaatgccccgccgaaactaccgatgccgttttccttcgaaccaaacgctccaagagctctatttccgctggaccagtaccgtctgcagctttaccagtacgcagtcgctgaacgtttacgatatccgctactcaatccatttccgtcaactttgacatgttaccccctgttcccaagagctctgcagccggaggaaccaaaaccgcaacacagttacatcggcttgatcgcgatggccatactaagctccccggaatcgaaactggtgctatccgacatctaccagcacatcctggaccactacccctatttcagaacgagggggcccggctggaggaattccatcagacacaatctctccttgaacgactgtttcataaaagctggtcgtagtgctaacggaaagggccactattgggccatacacccggccaacgtggaggacttccgcaaaggcgacttcaggagacgcaaagcgcaacgaaaagtccgaaaacacatggggttggccgtcgatgaagacggtgcagactctcctagtcctccaccgctttccgttagccccccggtcgtacctggcccctcaacgtcagtgtacccgatagtctccacaaggggggcaccaactaggaagaggcagttcgatgttgcgtcacttctagcccccgattctggggaggattcgaacgaagaggatatcgacgtagtttccagtgaccagcaagaaaaatccgaggctaaacagcagtggcctatgtttcctatagtcgactattaccaggcgctgctacatacaagaccgatggggactatgaagcccgaaactagcacggatagttcgaattct

SEQ ID NO: 932 - DNA, 865 bp, Leptinotarsa decemlineata
atggcagatgtaggtgttcttttggactacgaagatgagatgaataccgaacagactaccgctgagcccacagctaatgaagtacagaaggaaggggccaaaggcacttatgtatctatacacagttcaggctttagagattttttattgaaatcggaaattctaagagctgttgttgactgcggttttgaacacccttcagaagttcagcacgaatgtattcctcaggcagtcattggtatggacattttatgtcaagccaaatcgggtatgggcaaaacggcagtgtttattctggcaacactgcaacaactggaaccagcagaaaatgttgttaacgttttggtgatgtgccacactcgcgaactggccttccaaatcggcaatgagtacaagaggttcagtaaatacatgcctggtgtcgaggtgggcgtctttttcggaggtatgcctattgccaacgacgaaggaattttgaaaaacaaatgtccgcacattgttgtaggaacgcctggacgtattttggcgcttgttaagtcaggaaagctagtcctcaagaacctgaaacatttcatccttgacgagtgcgataaaatgttggagctaatggatatgaggcgagacgtccaggagatatacagaaacaccccacacacaaagcaagtcatgatgttcagtgccacgctcggcagagacattaggcaggtgtgcaagaaattcatgcaagaccctctggaggtgtatgtagacgatgaagccaaactgtcgttgcatggattgcaacagcattacgttggactcaaagaaaatgagaagaatagaaaattatttgagttgctcgatgttctcgagttcaatcaggtgg

SEQ ID NO: 933 - DNA, 425 bp, Leptinotarsa decemlineata
agttcaatcaggtggtcatttttgtgaaatcagctaaaaggtgtgtggttctagaacagttgctgactgaagagaatttccctgccatcggaattcacagaggaatgagccagaaagggaggctgtctcgatatgagcagttcaaagatttccggaagagaatattggtagctacggatctctttgggcgtggcatggacattgaaagggtcaacattgttttcaactatgatatgccagaaaactccgatacctacttacacagagtggccagggcaggccggtttggtacaaaaggtttggccatcactttcgtttccgaagagggggatgtcaagattttgaacgaagtccaagggagatttgccgttgatgtcacgaagttacctgatgaaattgatctcagctcctacattgaggggcga

SEQ ID NO: 934 - DNA, 880 bp, Leptinotarsa decemlineata
atgggaattaaatttctggaggtgatcaagccgttttgcagtattctgcctgaaatagcgaagccagaaagaaaaattcaattcagggagaaggtactatggaccgcaataactctattcatcttcttagtttgctgccagatccctctatttggtataatgagttcagattctgcagatcccttctactggattcgagtaattctagcatcgaatagaggtactcttatggaattgggcatatctccaatcgtgacatctggattaataatgcaacttttggctggagccaaaattatagaagtaggcgacactcctaaagacagggctctgtttaatggtgcacaaaaattgtttggtatggttatcactgtcggtcaagcgatcgtttatgtaatgaccggcatgtatggagaccctgcagaaatcggagcgggagtctgtcttctgatcatcatccagctctttgtggccggtctcatagtgctgctgctagacgaacttcttcaaaaaggctacgggctcggttcgggaatttccctctttatcgccactaacatctgcgagaccatcatttggaaggctttctctccagcaactgtcaacactggacgcggaaccgagttcgagggagcagtcatcgctcttttccacttgcttaccacccgacaggacaaaatcagaggactcagggaggcgttttaccgtcaaaatctacccaatctgatgaatcttctagctacagtctttgtatttgctatagtgatatacttccagggattcagagtagatttacccatcaagagtgctaggtaccgtggccagtactcgagctaccccatcaaactgttctacacctcaaacatccccatcatcctgc

SEQ ID NO: 935 - DNA, 211 bp, Leptinotarsa decemlineata
tcaagttccagggcaactttctaatcaacctgctgggtgtgtgggcagatgtgggcggcggaggccccgctcgctcctaccccattggcggcctgtgctactatttgtcgcccccagagagtgtcagccacatcctggaagaccctgtgcatgccctactttacattgtcttcatgctgggctcgtgcgcattcttctccaagacgtggat

SEQ ID NO: 936 - DNA, 244 bp, Leptinotarsa decemlineata
ggagcagcagatggtgatgcgtggacacagagacaactccatgatccacgagctgaacaggtacatcccgacagcggctgcgttcggaggcctctgtattggtgctctctctgttctcgcagacttcatgggggccatcgggtccggcacgggaatcctcctcgccgtcaccatcatctaccagtacttcgagatctttgtcaaggagcagagcgagatgggcggcatgggcgctctcctcttc

SEQ ID NO: 937 - DNA, 390 bp, Leptinotarsa decemlineata
atggatcattctttatctcagaacactccgctgcactggggttactccagcaacaaccctccggcttcatcttggccgacagtgtccagaggggtcaagagacccatgtctgacagtgactgtgatgatgtctactcagaagaatcatccaaagaccaatgcacatctcctggtgacgctgatagttgtcaaatgttatccagaaagaaaagaagaggtgtgatagaaaagaaacgaagggacagaattaatatgtcgcttagtgaactgaagagactcgtaccaagtgcctttgaaaagcagggatctgccaaactggagaaggctgaaatcctgcagatgactgtggaccatttgaaaatgcttcattctaaaggtaggttcaaatta

SEQ ID NO: 938 - DNA, 357 bp, Leptinotarsa decemlineata
atggatcgatgtgaacagctgatggaactcatgcattgtagagcaagaaggcgtttcactagaggacttaaacgtaaacctatggcgttagtaaagaaactccgtaaagccaagaaagaagcccctcctctagagaagccagaaattgtaaaaacacatctacgtaatatgataatagtgcctgaaatggttggttctattgttggtgtttacaacggtaaagccttcacgcaggttgaaatcaaacctgaaatgattggacactaccttggagaattttctttgacctacaaacctgtcaaacacggtaggcctggtattggtgctacccacagctccaggtttattcctctcaaa

SEQ ID NO: 939 - DNA, 508 bp, Leptinotarsa decemlineata
tgagaagaaagagaaacaggtcgaactccagaaaaaaatccaatcgtctaacatgttgaatcaggctcgattgaaagtattgaaggttagggaagatcacgttcgtaccgtactagaggaggcgcgtaaacgacttggtcaggtcacaaacgaccagggaaaatattcccaaatcctggaaagcctcattttgcagggattatatcagctttttgagaaagatgttaccattcgagttcggccccaggaccgagaactggtcaaatccatcattcccaccgtcacgaacaagtataaagatgccaccggtaaggacatccatctgaaaattgatgacgaaatccatctgtcccaagaaaccaccgggggaatcgacctgctggcgcagaaaaacaaaatcaagatcagcaatactatggaggctcgtctggagctgatttcgcagcagttggtgccacaaatccgtacggctctgtttggacgtaacgtcaacaggaaattcaccgat

SEQ ID NO: 940 - DNA, 1407 bp, Leptinotarsa decemlineata
atggttcattcaacctacgcccaaggtcatgttatgggaggtcgtgactcgggtcctctgggcatcccgaaatcgccgtcatttcacagcggactcgatttagtagcctcggcaagcgtggattctctcaaagccgccctcgacctgcaggacaataccggtttcccgagcaagagttccctttacggagagggcggtagagccgccacaaacggtggggaaatgacaactgttggtgatgcagctcctgacgatagagaagaattgtttgttcaaaaaatcagacagtgttgtgtcctttttgatttcgcgacagatcctttatccgatctcaaaggaaaggaaatcaaaagggctgccctccaagaaatggtcgaatatgttacacagcagaaaggcgcaatcaccgagactatatattgtgaggctgtaaatatgtttgctgtgaatctttttcgaacgttgccgccctcctccaaccctaatggagccgaatttgacccagaagaagatgagcccaccctagaagctgcctggtcgcacctccagctagtctacgagttattcctcagagtattagaagcaccagatttccagcccaatgtcgctaaaagatatatagaccaaaaattcgtgttgcagctgttggatttgttcgattcggaagatcctcgagaaagagatctactgaagacaactcttcatagaatttatggcaaatttttgggtctgagagcttttattcgtaaacaaataaacaatgtattttataggtttatatatgagactgaacaccacaacggtatagcagagcttttagaaatcctgggatccattatcaacgggtttgctttgcccttgaaggaagagcacaaggtatttctcttgagagttttaatgcccttacacaaggtgaagagcttatcagtataccatccccaattggcctattgcgtagtccaatttctagagaaagatccgtctcttacacaaccagtcatgaggagcttactaaagtattggccaaaaacgcacagtcccaaagaggtcatgttcctgaatgaactagaagaaatcttagatgtgatcgaaccggctgaattccagaaagttatgctccctctgttcagacagttggctaaatgtgtgagttcgcctcattttcaagtagccgaaagggccttgtactattggaataacgagtatgtgatgtcattggtatcggagaatgctgctgagattctgcccattatgtttccgagcctgtacagaaattcaaagagccattggaataaaactatacatggcctcatttataatgctttgaagttgttcatggagatgaatcaaaagttatttgatgagtgcacgcaacagtatcgacaagaaagacaaaatgttgagaac

SEQ ID NO: 941 - DNA, 402 bp, Leptinotarsa decemlineata
atgtcgccgtggagcagtgccggtcttcaaccaacaacagggtactatccgtacgatcctactttagcagcttatgggtatggcgcagggtacgatctcgcagcccgacgcaaaaacgcgacgagggaatcaacggccaccttgaaagcgtggctgaacgaacacaagaaaaacccctaccccaccaaaggagagaaaatcatgttggccatcatcacgaagatgacgttgacgcaagtgtcaacgtggttcgccaatgctaggcgaaggctcaaaaaagagaacaaaatgacttgggagcccaagaacaaaaccgatgatgatgacgacgctttgatatctgacagcgacgacaaagataaagacgatgacgacaagagggatgaaacagacatccacggc

SEQ ID NO: 942 - DNA, 837 bp, Leptinotarsa decemlineata
gaaacagacatccacggccgtataaaatcggaacggaacggtaaggacttagacgacgatgatatgaccgacgaggaccgaaaggacgacattctgggaggaaacatgcaccacatccttggcaacggtttcggcctgaagtccgaagtgaaatcttcagactgcgggattccgctgcccccatccaaacccaaaatctggtccctggcggataccgctgcttgcaagacccctccaccccctccgtcctcccagcagcaatggttggggggaaatggattcgccctccccagttcccgatacagcgggagtggattccttcccagccactgtcagcaggggtttcccgatgttcagactgatacgcccccacagacccccccgaatatgaagcttcccagtgtggctggtaacctgatccctggacaaggaccctgcatagggtcttcttcgggaaatggtggttatggacaggctgggtttttggggggattcggaaggattcagtcaccgcagagaatacaaggtcaacagtcgagtcagatgcccgcccccacgcaagacaatgccgccttcaagcctttttataaaagtacgaaacttttcttccattatgtgaacaaattgccgaaagaattcgataaatttccccatcgtttcctcccaaagcatgaacggagggtttgtgtcgccggtttgagccgctccctacatggcgaacgagtttccgaagtcaacaaattacgggcaaagtgcaaacgaaacaagtatacagtgagtgatgaacacttgaagcagtctgttgtacatttgtgtaaatgcatttatttatatctg

SEQ ID NO: 943 - DNA, 370 bp, Leptinotarsa decemlineata
atgcctcagccagatccgtcgatagataccagcaggatagatgagattccggcaaaagaacctaagctgaatgctaaacctctgaagtctgcgatgaaaaagaggccaggaagtcaggagggattctctctaatgattacaagcaaaccggtacgatttggcttgccaaccactattgaaaacaaggagaatgccaggccgaacataattcacgaagatgatgacagcgactcaaacgatggtcccattctgtacagagaagatggaagtttatcagaagaacgtatgctggctctaaaaatagcgaggaaagaaagtttgtcgctcaagctcgctcttagacctgacaaacaggagctcatcaacagga

SEQ ID NO: 944 - DNA, 648 bp, Leptinotarsa decemlineata
ttgaagcgtttgaatgccccaaaagcatggatgttggataaattgggaggtgttttcgcacctcgcccatctacaggacctcacaaattgcgagagtctttgcccttggtgatcttcctacgtaaccgattgaagtacgctttgactaacagcgaagttactaagattgttatgcaaaggttaatcaaagtagatggaaaagtaaggaccgactccaattaccctgctgggtttatggatgttattaccattgaaaaaactggtgaatttttccgactcatctatgatgttaaaggacgatttgcagtgcatcgtattaccgctgaggaagcaaagtacaaactatgcaaagtcaggaggatgcaaactggccccaaaggaattcccttcatagtgacacacgacggacgtaccatccgttatcctgacccaaacatcaaggtcaacgacaccatccagttggagattgcctcttgcaaaatcctcgattacataaaattcgaatctggaaatttatgtatgataactggaggaaggaatttgggtcgtgttggtacggtcatcaatagggaacgtcatccaggttcctttgacattgtacatgtcaaggacgccaatggacatgttttcgctactagtttaaggagg

SEQ ID NO: 945 - DNA, 426 bp, Leptinotarsa decemlineata
atgaagatcggactctgcgcctacagtgggtataaaatttacccaggccatggaaaaactatggttaaagttgatggaaagacattcaccttcctcaactcaaaatgtgaacgggctcaccttcttaagaggaatcctcgtaaagtaacttggactgtcttgtacagacgtaagcacaggaagggccaggaagaagaggccacaaaaaagcgaactaggagaactcaaaaattccagcgagctattgtaggagcatctctgaatgacatcatggccaagaggaatcagaggcccgaagtgaggaaagcacaaagggaacaagctatccgtcctatcctgcttaaatgtaattggatgaaagtgaaccaaattgctaaaaccacaacaatttatcgggctgctgttttcaatactctgttgagtgca

SEQ ID NO: 946 - DNA, 402 bp, Leptinotarsa decemlineata
atgaattaccacaaaataaacagactttttggatttaggcgagccatgcctgtgacaggaagaattctgaatatgacaacagagctctatcaaaaagccgaaggtgatctattgaacacatttttcgtctctccaagcgataatctgtgcttccatggcaaatgctcgtactattgcgatacgtctcatgccatttgcggaaatcctgatacgctggaaggaagtttcgccgccttcctgccgtccagtaaacttgctcctacaaaggagttattaatttttgagaaagaaagtttttggctttctactactccatctcgatacaaaaaaagatattactggagttttttcccaacaccaaatcgttatttctacaccgcgacacgtgtttcgatcaccaag

SEQ ID NO: 947 - DNA, 355 bp, Leptinotarsa decemlineata
atgtcttttaccggcagtttccaccaaacaagccagtttgcgttctcagctcgcgtccgccgacataaattcctgcagcgacatataaattccctgcacctcgatacttttaatccactaataccaaaaaaccgatatcgtattgtttctttaacagttcttggtctctgtacagggaaggccctcatccaaacctgcctgaactccccggacccccccgccggctctgcgggcggtgaccagcggatgtcggccaccggattcgaagagaccgagctgacctacaacatcagtgacgacgactccaaagtaagacaaatggtgtacggctcgccgcacacacacgcacacccgc

SEQ ID NO: 948 - DNA, 315 bp, Leptinotarsa decemlineata
acacacacgcacacccgcactctttggccagccagggtcactattcgcacctagaacagacccatctgggtttgggggggtcgccgcaacacgggggctactcgcaagcgtgtcccagtccgctgcccccgtcgcaccagggttacggccacccccagcatccccacgcgcatatgcactcgcacccccaacgatattattctatgagcttcaagattccatcaacaaggtatcgaaaacaaacattgcaaagagatattttttttggagaaacatattttattttttgtcagttttctttaagaatgaattcaa

SEQ ID NO: 949 - DNA, 473 bp, Leptinotarsa decemlineata
ggacaaaaaagaaaaggatgatgttggtacagtcattggtatcgatcttggaactacatattcttgcgttggagtgtacaaaaatggtcgagttgaaattatcgccaatgaccaaggaaaccgtataactccgtcttatgtagctttcactgctgatggtgaacgtctaattggagatgctgctaaaaatcagttgacaactaatcctgaaaacactgtctttgatgccaagagactgattggtcgtgacttcacagactccactgttcagcatgatctgaaactgtttcctttcaaagtaattgaaaagaatcagaaacctcacattcaggtagaaacaagccaaggtaataaagtgtttgctcctgaagaaatatctgccatggttttgggaaagatgaaggaaacggcagaggcttacttgggtaaaaaggttacccatgcagtggtcacggtacctgcttacttcaacg

SEQ ID NO: 950 - DNA, 367 bp, Leptinotarsa decemlineata
acaagaagaagaagggcaaagacatcaggaaagataacagagctgtgcaaaagttgagacgtgaagtggaaaaagccaagagagccttgtctgccagtcatcaagttaggattgaaatcgaatcattctttgaaggtgatgatttctcagaaaccttaaccagagctaaattcgaagaattgaatatggatctgttccgttcaactatgaaaccagttcaaaaagtactcgaggatgcagatatgaacaaaaaagatgttgatgaaatcgtcctcgttggaggatccacacgtatcccaaaagtacagcaactcgtcaaagaattctttggtggcaaagaaccttcaagaggcatcaatcccgatga

SEQ ID NO: 951 - DNA, 460 bp, Leptinotarsa decemlineata
aaggtgaacgtccaatgaccaaggacaatcatttactcggtaaatttgatttgacgggcattccaccagctcccagaggtgttccacaaattgaagtaacattcgaaattgatgctaatggtatcctccaagtatctgctgaagacaaaggtactggaaacagagaaaagattgttatcaccaatgaccaaaataggttgacccctgacgatattgacagaatgatcagggacgcagagaaattcgccgacgaggacaaaaaactcaaggaacgtgttgaagccaggaacgaattggaaagctatgcatattcattgaagaatcaaattggcgacaaggaaaaacttggtgctaaattatctgatgacgagaagaccaaaatggaggaagccatcgatgagaagatcaaatggttagaggacaaccaagatactgaagcagaagactacaagaaacagaa

SEQ ID NO: 952 - DNA, 1476 bp, Leptinotarsa decemlineata
atgaagcatttactcaaaagctcgtacactcggttgaaaatgaagcttattccagggcatcttcctcccatcgcaacaagcacaaatatggaccgtattcctttgcctctatcgttcaatgcagatctgctatggaggtatccattaggttttccacctttatctcaccagaatccaccttcgtctcctttgtgggattacaaaagtcaacttccagcttcgcttccttcagacccgagactctggaatagggaagacgtaattacttttttgcaatggtcagaaagggaatttgatatacaacctatagatcatgaaatgtttcaaatgaatggaaaagctatgtgttttcttaccagaaatgatctatctgagagagctcccggttccggagatgtattgcataatgtattgcaaatcttagtgcgggaagcaaacaatttgcagaggatgctaccaaatagtcccgttacgccgacatcaagacatccgtatccattatcaccacattcacatcctcctacacctaactggaacatattatcacaaaacaacgaatcttcgccttcttcacatgctgcttcactggctgctcagttgatggcccaaagtaattcagtgattcttagtcctgctccatcgatcgacagccaaacaagcagcccattgcatgcggataaccagggtttcggacactctatcttcaatgtgaatggaagtaatggcagtggttctaatccttcggattcagatgaagataatgcagataaaaaaggttttaatggaagccctcctagcactcctagtgcctacagtttaatgcctcaaataccatatctacttcctagaagcccacaagaatcggcttccagtcctatcagttataagaattctggtcgggagttttttcccagtgactgtcctgagccaaatacaaatggaaggttactgtgggattttttacaacaattactcaatgatcctgctcaaagatacacaagttacatatcttggaaaaatcgtgaaactggagtattcaaaatagttgatccatcgggtcttgcaaagctttggggaatccagaaaaaccatttatcgatgaattacgacaaaatgtctagagctttaagatattattatagggtgaatatcctaagaaaagttcaaggagaaagacattgttaccaatttctcagaaacccaactgaactgaagaacatcaaaaacatatcactattgagacaacaaatgtcccccactagtactaaaccaccaatagctacaaatatttcccagagtatagttaaatctgaacctgccgaaatgtctgatgaaataacttcctctagatcttccactgagtatgatgagaaaccaacggatttgagtattgatggacctactgacctcagtaacaacacaagacacataaatattgtttgttcgcctgaccctcccatcacaggaccccatcat

SEQ ID NO: 953 - DNA, 991 bp, Leptinotarsa decemlineata
atgaccataagggctatccagaagcagttggccttcatgttgggtagacaacagatttacatagaaattcccgagagtactccagaatatgaagatattatagaaattatggctaactgccacttgaacaatcacttcctgaatcttgccagggagcttgacatcatggatccgaaaactcccgaagatgtttataaatcccatttggaaaatagtcgtcctccctttggaggcagtcaagttgattctgccaggcaaaatttagcagctagttttgtgaatggattcgtaaatgcggctttcggccaagacaaacttctaatggaggatggaaataaatggctttataaaaacaaagagcatggaatgctgagtgccaccgcctcccttgggttagtcctcctctgggatgttgatggtggtctgactccaattgataaatacctgtattcttccgaagattacataaaatctggagctctgctagcttgtggtattgtcaactgtggagtccgaaatgagtgtgatcctgccttagccctcttgagtgactatgttcttcataatactaatattatgaggataggagccattgttggtttaggtttggcttacgttggttctaacagagaagctgtcctgagtctgctcactccagtattctcagatcctaaatccaacatggaagtaataggcatgtcggcattagcctgtggtatgatcgctgttggatctggcaacccccaagtcaccacaacaattatgcaaactctaatggagaaatcagatacagaactgaaagatacatacgctcggtttttgcctttgggtctgggtctttgccatttgggaaaacaggaaggtatagatactattattgccactttggaagtcatacctgaacctttccggtcgatggctacaacaatggtggacatttgtgcctacgctggaacgggaaacgttctcaaagttcagaatttgctgcaca

SEQ ID NO: 954 - DNA, 439 bp, Leptinotarsa decemlineata
tcagaatttgctgcacatttgttcagagcattatgaaggctctgatagcaccgacaaaagctccaaagataaggacaaaaaggaaactgttaaagaaaaagatctatctaccaggcaggctgtagccgtacttggtattgcattgattagcatgggggaagatattggcagtgaaatggctttcaggacatttgggcatttacttcgttattgtgaaccagcgattcggcgagctgtacctctggctttgggactcatctccgtgtccaatccaaagttgggcattctcgacaccctcagcaagttttcacatgacagtgatgcagaggtcgcccacaatgctattttcgccatgggattggtcggagctggtactaataatgccagactggcagccatgttgaggcagttggcacaatttcatgccaaggacccaaac

SEQ ID NO: 955 - DNA, 623 bp, Leptinotarsa decemlineata
atgattgacagcagtgatactgatgaggaatttagtaaattttgttcgaagaatgaaaaatccagacaagatatcgttagtaaagccaaaaaacggataaaaaaaaccattgttctctctgactcggacgaatctggtagtgataaaaagaagaaaaacaatagtgaagactctgacattaagagtgacaaatcagattcgaataaatctagtgaagacgagggagaaagtgaagaaaataagaagcccaaacgtaaaagaattaagaaaacaaaagacagtagtagtagtagtgaagaagatagatctaccagaaaacaaatcagaaaagtattagatagagcctctttatctgcaactaccaaaaaggcagaagctgatgaaaaggaacgtaaggctcgtatcgctgaaaagcaaaaaaaatataataatatttttgaagaaaagaaagattctaaaatagaaaagcttgttttggaccatgacgagaatacaaagaaagatgtacttgaagttcataaaaaaattgtcaaaaaattgaaaccacatcaagcaaatggtatccaattcatgtgggatgcttgctttgagtctgtcgaaaggttaaaaaaagaacctggatc

SEQ ID NO: 956 - DNA, 2119 bp, Leptinotarsa decemlineata
agcagaattcaaaaagtggattcccagtagtgatacacttgaggtttatgaactagtgtcttgtaagaaaaatttcgaaagacagtacattgtgaatgaatggcatcaagaaggaggagttttaataataagttatgccatgtttcgaaacttgagcaaccctgataataagaaacttagtaaaaagctaaggaacgcttttcaggtgggattcatcgatccaggtccagatttggtggtgtgcgatgaaggtcacctactcaagaatgagaaaaccaatttgagtattgcaatgaatagaattaagactgctcgcagaatagtcctcacaggtacaccactacagaacaaccttaaggaatattggtgcatggtgcaattcataaaacccaatctgcttggtacttacaaagaatacatgaaccggtttgtgaaccccattactaatggtcaatacaccgattctacaccacgagacactattctgatgagaaaaagatcacatgtgcttcacaagctcctagatggtgttgtacagcgtagagattatgctgttctagaaccatacttgcctccaaaatatgaatacgttctttttgtgaagctgtcagaaactcaagtcaaactataccaacactacatggacaaatatgctcgacaaagtgatggttcaaatagaacttcatttttgttcacagattttcagaaactacaaagaatttgcacacatccaagaacactggctgaaaagggtagcgaaaaaaaagagaagtttgatgatgaagaatctgaaggttctttgaaggattttattgatgatgcagaggcatcatcttctggaaaatcgtcatcaaattcttccggttcggaaacagatgacagtggttctgggagtggggataagatgaaatcgaaaaaacaacaaaaaacaagagtaaccagagcacaaactgcctacagaaaagaaaataatgaaggtagtgatccagaattggttgaagaggtaaaaaaggaatggtggcaggagtactgtgatggtgaggaattggacaatattaataatagtggaaaattatttttgttgttcgaaattctgaaagagtgtgaagaaattggtgataaagttttaattttctcgcaatcgttgtataccttgaactgtatcgagtatttcctagagaaaatagacgaagctactcaaaatggcacacctgaaaaaataggcggctataaaggatcttgggcattaggtctggactattttcggttggatggttcttccagctgtgataacaggcacaattggtgtgacgtgtttaacaatccaaacaatataagagctaggttgtttctgatatctaccaaggccgggggattaggaattaatttagtagccgctaatcgagtgatcatttttgatgtttcttggaatccctctcatgatatacaaagcatttatcgagtttacaggttcggccagacgaagccgtgttatatttatcgctttgtcacatacggaacaatggaaatgaaaatatatgaacgacaagttacgaaacaggcgatttcaaaaagagtgatagatgaacagcaaatcgacaggcattacaatcaaaatgatttgcaggagctctataagtgcgatctggatcctactgacagacccatacctatggtgccaaaggatgttctcttgggcgaaatgttacagaaacacgagaaaacaatctataaatatcatttacatcagtctttattggagaataaagaggacgaagggttgaacgaggaggagaggaaagctgcttgggaagaatttgaaaatgaaaaggtcattcgaaaatacacttataataatactggtatggctcagatgaaccagggaatgatgagtgctcaagcgatttcagcagctttggcaaatattgtgagaagggacaatcctgattggtccgaaattcaaatcaaaagtatcattcctgcccttgttcagcagctgcaggttcagttagctgaaaatgacatgtcgatgtatggtcgtgtgatgcaagaaattcaactcatgagagcccagaaaatgagagaagcctactaccaaaatcaaatgatgaagctgatt

SEQ ID NO: 957 - DNA, 202 bp, Leptinotarsa decemlineata
aatgatgaagctgattcaacaacaacagaatcgacaaaccgtgttgggaaatttgaatgtaaatccagcacatttagcacaattatacggtaatgtcggcaatttctttaccggcactccaaatgtcagtgggattaatttgaacaagccaagctcttcaaggtcaataccaagaccgaatgatgtcatagaattgaatgac

SEQ ID NO: 958 - DNA, 310 bp, Leptinotarsa decemlineata
ctgaaggtcggagtgattttcgtgaaggaagggcaatataccgaagaagaaattttagacaataacgacaacacgcttttgttcgaagagtttttacaaatattaggagaaaaggttagactgagaggtttcgatagatacaaaggtgggctggatactgtacacgacctcacaggtttatattcggtctacaccaattggaggaacatcgaaatcatgttccacgtcagtacgctcttgccttatgaacgccacgatccgcagaagttgcagaggaagaggcacattgggaacgatatcgtctgcgtgg

SEQ ID NO: 959 - DNA, 579 bp, Leptinotarsa decemlineata
acgatatcgtctgcgtggttttcctcgaagctgacaatacttcgttttctcctgcttgtatcaagagccactttctacacactttcatcttggttcgaacatctcctaggataaaaaggaaacccacccgttacgaagtgtccgttgtaacaagagatgaagttggtgcgtacaaaccttatttgtgggaacaaagtgttttcgacaagggatcaatgtttcgagaatggctcctcacgaaaattgtcaatggagaaagggctagctattcagcaccaaaatttgcaaggatgcaagaaaggacgaggtcgcagatattggaggacattgttgcgaatctacaaaatcacgctgagactggacaaattccaaagccctacaggagaggttcttggagacccattggccacatgcgaccttcttccccgctcttggacagtgttcgtgatcagttcgaaggttacgaccaaatcgccaaggatttcaccaaaatgtttctcaataacgagccgaatactaccatcaacgcccaattattcgacgtggtattcatggtccgcagcagagtcttccaggaaa

SEQ ID NO: 960 - DNA, 1063 bp, Leptinotarsa decemlineata
cagagtcttccaggaaatgctctacggcatccagacgggcttcggttccccccaggtccccgtcgcagaaattctggctcgacccgttccctcgctgctcagtccgcagcagtttcggctgaagagcagcaattttctgcaagtgcctgacccggagacgccgcgcccgaagagcgtgcccagttcacccatggtgaagagagccatcacgagactgggcaccatcacggccgggtgggggaggtccatcaggaagcacaacgcccagcagctctcttcggacgataagaagaagtgggccagcagccacgattataaagatgataaagataaagacggaaaggaaaaaccgaacctgtcgcaacttcccgtaccaagactaagcgtatgcgctaatgctcaaaaagtattactggattatctgcacacggggacctgtcctctcacctgcggcaatgttcctggattgatatgcgcagctgaacattacgacctacctgagcttcttcaggcgtgctttcatcatgccaaacagtttttgaggatggaagtggcttgctcgatgctggtcgctctggagaactattactggaggtacacctctgcgtcggagttggtgaacatgatattagtgtttttggagtcaagatgctcaatattattcaatatggatgacttttacgaattgagcgagtctgttgtccaaatgattatgagcaggaatcttgacgtacctgaaatcgcgaaatttcaagcaatccatgagtgggcaaaacataaaatcaagaataaaacttccaataaattggatgccaaattagagttcaggggtataatggaacgattaactagagaactcaaattgtacagaattactccacaggaaattattaagattgttctcccctccaaaaccatcaaaaatgaaaggatattggaaaccctcatgttccaagccagttcaggcatgtacagaatgcaagacgacatcattgaggaatgcacccaaagactgcagaaacaagagtctcggttttcagaaatggaatcctttgactataac

SEQ ID NO: 961 - DNA, 1047 bp, Leptinotarsa decemlineata
atgaagacttcccaaacagaagctgccagaaatcgaacaactctagacttccacatagaactattgaggctgagacagaattggcgattgaagaaggtgtccaatacgataattggaggtctcagctaccgaacaacgggttccaagtatctgcaaactggtacatttgaaataacgaaagctgaagacgaagagaaggtcaatagttcatcgagtagtcctttacctggtggacctgccctagccaaggttaacaacgctcttagagtttcaataccaaccaaattgcaaggtgttgcatacattgaggtgctttgccgaacagaccaagaagatctctgcaacgtcaagctgaacctcctcggcaccgactcgcctccctccaaccccgacatgcactggcaacaaaaactagaagccacccagaatgttctcttctgcaagaagctgttcaaccagttggccacagaggcgatccaactgcaggcccccatcacgcacatgatagtcggtaaccagataaaggcgactgttctgcctgggatccagttgacaatcgcgttgaggcatttcacgacaagtgacgagaagaagcagaaacccgctctgtcgaagagctatcatgatcatgttctggagcattctctacatcagttgttgagagaggttcataataagaatactcatcatccgtttcctcatcccgctacagggcctttcggtccttccaagaaatggatgattgcaggtcccatgacagcagataggttcgagctcctagaaatgacgaaatcgcaaacccttcttgaccaaatcgtacagcaagcccagcattccataatgtgcaggcgcacggagtacgttctagccaccatagccaaggaagtgaaagaccccttgttaactttccactggaacaccctgaacacccccacgcaatcctgtgtaaaattacagatcttgactcatgggtacgacgccgtctgtcggacgcctctcatcatccacgtgggagttaaaagtctgaagtgcatttgcaatttgcag

SEQ ID NO: 962 - DNA, 1137 bp, Leptinotarsa decemlineata
atggaaagattccgtatgtggtacatgcacgatggtgctccaccacactttagtgtagtggcacgacaatttttggatgaaaattaccataatcgctggattgggagagcaggcctacacccatggccacctcgctcgcccgaaatgaattccttagattattttctctggggacaccttaaagcgttggtatacgaaactgctattcaaagtgaagaggatttacggaataaaatcatcaattcatgtgacataataaaaaatacgccagctctgtacgatgccacatgcacttggagtggggtgttaccttcgcgatccagcgtgaaacccacaggatattcgagcaaggtttttttgggcggagtaccttgggacatatcggaacaattgctcgtacaaactttcaagcagttcggaccgattcgcgtagaatggccgggcaaggacaagcaggcttcgcagccgaaaggatacgtttacatcatttttgaatctgagaagaacgttaaggctttactgcagtgttgcactaacgattacgccaacagcggcaattggtactacaagatcagctctaagagaatgaaggcaaaggaggtgcaagttatcccttggattataaacgattcaaactataccaagtctacttcccaaaaattggatcctagtaagacagtatttgtgggtgctctgcacggtatgctcaatgctgagggactagcaaagatcatgaatgatcttttcgatggagtagtctatgcgggtattgacactgacaagtacaaatatccaattggctcaggacgtgtgactttcaacaaccagaattcctatataaaggcggtagctgcagccttcatcgaaataaagacgtcaaaattcactaaaaaggtacaagtggatccctacctggaagactcgctgtgctccatttgccaggtccagcagggcccctacttctgcagagacatgaactgcttctgctacttttgccgcacctgctggcaatggcaacacagcagcgagttccgccaccacaagccgctcatgagaaactcgaagaacaaccaagtcgtcggtctcggcaccatgccgccaccgccatctccaggtacttccgcttcttcgccaaac

SEQ ID NO: 963 - DNA, 1008 bp, Leptinotarsa decemlineata
ttgaactttttggaactaacggaattgaaacacgttctggaaaaaacccaagtatttttcaacgagcaagatgaagctaacggatttcctgattcagttcacaagtcgctcattcctgcagaagaccataacgtatcgataagaggtcgtttgggatttgttgctggagtgataaatagagaaaaagtgccatcttttgagagaatgttatggcgagtctgcagaggaaatgtattcctgagacaagctatgatagaaaaacctatggaagatccagccacaggaaatgaataccataaaacagtttttgcggctttcttccaaggagaacagttgaaaacaaggattaaaaaagtatgttccggttatcatgcctctttatatcactgtccgaatacaattacagaaagagaagagatgctcagaggggttcgcactcgtctggaagatttgaatttggtcttaaatcaaacccgagatcatcgacagagagtacttgtaagtgtagcaaaagaacttcagaactggagtataatggttagtaaaatgaaggccatttatcacacactgaactttttcaatatggatgtaactaaaaaatgtctgataggggaatgttgggttccttctaatgatatacctattgtacaaaaagccttagcagatggatcgaacgcttgcggtagttccattccatcatttttcaatgtgatcagtaccaacgaggatcccccaacattcaacagaaccaacaagtttacaaaaggtttccagaatcttatcgactcgtatggagttgcttcttatagagaggtcaatccagctttgtactcaatcgttaccttcccgtttctatttgctgtaatgtttggtgattgcggacatgcaatcattatgtttggttttggcttgtggatgattctctccgaaaagaaaattgcacttcaaaaaaataagagtgaaatcttcagtatattcttcggaggtagatacattattttcttaatg

SEQ ID NO: 964 - DNA, 234 bp, Leptinotarsa decemlineata
tacattattttcttaatgggcattttctctttctatactggatttctgtataacgatatattttcgaagtcaatgaatatattccagagcagttggtttgtgaacgaaacatcacttaatcattcaatcaatgacaatgatatcaatttcattcctaaagcaaattactatggaacaccttacttcattggagtagatccagcgtggcagactgcgaaaaataaaattatattt

SEQ ID NO: 965 - DNA, 257 bp, Leptinotarsa decemlineata
atgagtcagactgagactctgattttgtatgcagggaatcacaattcatcaacccagatgggaggggaagtcaacatcgcaggcctactctccacccagcctgcccctgagtactggtgttcagtggcgtattttgaactcgatacacaagttggagaaacattcaaagttccctcaaactgcccgaacgtcactatcgatggatacgtcgatccttcaggaggtaatagattttgtttgggcgccttgagcaatgt

SEQ ID NO: 966 - DNA, 260 bp, Leptinotarsa decemlineata
ctgctactgctcaagctgctgcggcagcccaggcagctgcagttgctggtttgtctgccgccactggaatcggtgttgatgacttgcgaaggctgtgcatactgagattgagctttgtcaaaggttggggccccgactaccctcgtcgacagtcgatcaaggacactccttgctggatcgaagtccacctacacagagccctacagttgctggacgaagttttgcatacaatgccaatcgatgggccccgaggaatagag

SEQ ID NO: 967 - DNA, 498 bp, Leptinotarsa decemlineata
ctggaaactcctgaacaatgcccaagcgtagtttctctgctggctgagagttacaaccctcacgtacggtacggagctgccatggccctcggtatcgcctgtgctggcaccggactccgcgaagctattgctcttctggaaccgatggtgatgttcgatccagtcaatttcgttcgtcaaggagctctcatcgcttctgccatgatcttgatccagcagaccgaacagacctgtcctaaagttagtttcttcagacagacttacgcccaggtcatcgccaacaaacatgaggatgttatggccaaattcggagctattttggctcaaggaattattgacgctggaggcaggaatgttacattatcactccagtcgagaacaggacacaccaatatgttggcagtggtcggaactttggtgttcacccagtattggtactggttccctctctcccattgtttggctctggctttcaccccaacttgtgtacgaagtctt

SEQ ID NO: 968 - DNA, 448 bp, Leptinotarsa decemlineata
atgaaagccaagggagagttgaaagaatatgaagttatcgggcgtaagttgcctacagaaaaggagaaaacaactcctttatataaaatgaggatatttgctccggacccaatagtagcgaaatctcgtttctggtatttccttcgccagcttaaaaagttcaagaaagccactggcgagatcgtgtctgtgaaaccaattcccgaaaaatcgcctattaaaatcaaaaacttcggtatttggctccggtatgattcccgatctggcacccacaacatgtacagggaatacagagatcttagtgtttctggagctgtaacttcttgctacagagatatgggagcccgtcacagagccagagctcatgctatacagattatcaaagttgaagaagtcaaggcaagtgacacaaggagaccacaagttaaacagttccacgattcaaaga

SEQ ID NO: 969 - DNA, 453 bp, Leptinotarsa decemlineata
atggctcccagaaaaggaaaagtacagaaagaagaagtacagctttcacttggacctcaagtccgagaaggcgaaatagtttttggagttgctcacatttttgcaagtttcaatgatactttcgtccatgtaactgatttgtctggaagagaaaccatctccagagttactggtggtatgaaagtaaaagccgacagagatgaagcttctccttatgccgctatgttagcagctcaagatgtagctgaaaaatgcaaaacattaggtattactgcactccacatcaagttgcgagcaaccggtggtaacaagacaaaaactcctggaccaggagctcagagtgccctcagagctttggctcgttccaacatgaagattggacgcattgaagacgttacaccaatcccctcagattccactcgtaggaagggaggtcgtcgtggacgtaggttg

SEQ ID NO: 970 - DNA, 365 bp, Leptinotarsa decemlineata
tcaacataaagttaaggactttcgagagggaaaaggacaagagcctgctgctggactgaatcaggctattttgaagctatctgtaacttcagcagctcaacaaaaacaacaagaaattttgaagcaagtcgagcagccttttgtaccaaaggatcctccacctgaatttgaattcattgctgatccaccatccatatctgctcttgatcttgacattgtgaaactcactgcacaattcgtagcaagaaacggaagagcatttctcacacagttgatgaatagagaacaacgaaacttccagtttgattttctaaggccacaacattccttatttcagtatttcacgaaacttttggaacaatata

SEQ ID NO: 971 - DNA, 875 bp, Leptinotarsa decemlineata
aaaggcaaaggaggaggaaatcttggaaagagaaagagttgcttacgcacaaattgactggcatgactttgttgtggtagaaacagttgattaccaaccattcgaaataggtaattttcctcctcccactacaccagaagaagtaggagcacggattctcatccaagaaaggattgaagatggtgaagacatcgaaatgcagcttgaaagtgatgaggaagaaccaccaccagcggacgaaggactaagtacaatgcaagacaaaacacatagtcgtaaaggacgtgatgataatcgtattcaggatatggaggaggaaagttctgaagaagaagatgaatcctcacttaaaccacccccacctccttctattcaaccccctctgccacctgcacctgataaggttttagttaagaagtatgatcctaaacaagctgttaaggtaaccagaccaactgtaggcgatgactacttggtatcgccaataactggtgagaagattccagccagcaaagtccaggagcatatgcgtataggtctccttgaccctaggtgggttgaacaacgtgataagcaagttatggataaaatgaatcaagaaacagtttacgcagctggttcagcaatcgatgcttcattgaaacttctggcagaaagacgtacagatatttttggtgttggtgatgaggaaactgcaattggtaagaaaataggagaagaagatgttaggaaggacgagaaagtaatttgggatggacacacgagtagtgtggaaactgctactagagctgctagagctaacataacactggaagaacagatacaccaaatccataaggtaaaaggattactccctgatgaagaaaaagaaaaaa

SEQ ID NO: 972 - DNA, 627 bp, Leptinotarsa decemlineata
aagaaaaagaaaaaattggccccaaaaatatagggtcaaaatctggcaagatcaacattcagagtgtaataactacaaaaccaccaaatcaaccaccgccacctaagcctcaggtttctctcattcagacgcaaccggctcctccaatggctatacctgtacccccccaacctactatgatggctacgcaaccaccaataatgatgatgactgctcctcctatgcctccaatgagacctcctcctataatgatggcagcaccacctcctatggccagctttgttactccaatgcctcctcctatgggacagccaatgggaatgccaatgaaacatccaaacgatggtatgttagatgatgaaccaagtaataagaagttgaggaatgaagattctcttgtacccgaagaagtattcatgacaagaaatccaggtccagtgtctatcaaggtaacaataccacttttgcctgagaagtctgaatggaaattaaccggacaggtgatgagcctcacattacccttgggagaaagtgtggctaatttgaaggcaaaggtgcaggaagaaacaaatatgccaccagctaagcagaagttgtttttcgatggaatgtttttcaaggattcta

SEQ ID NO: 973 - DNA, 241 bp, Leptinotarsa decemlineata
gcccaatattggttatggatctaactccaaaactcgtcatatgcttcctactggattccgtaaagtgttggtgcacaacctcaaggaactcgaggtcctcatgatgcaaaaccgcaaatattgtgcagaaatagctcacggagtttcatcaaagaaacgcaaagaaatcgttgaacgagcccaacaacttagcatcagagtaacgaatggtcacgccaggctgcgtagtcaagaaaatgaa

SEQ ID NO: 974 - DNA, 600 bp, Leptinotarsa decemlineata
atgtcgtcgaaaatcatcaagtccggcggggctgagcccgatgccttcgaaacgcaagttgctcaagctctgcttgatttagaaatgaattcggacctcaaagctcagcttagggaattacacattactaaagcaagagaaattgagttgaacaataaaaaatccgttatcatctatgttccaatgcccaagttgaaacagttccagaaagtccaagcaaggcttgtacgtgagctggaaaagaagttcagtggcaaacatgtggtgtttgtaggtgaacgaaaaattcttcccaagccaacacgtaaaactcgtgctgcaaataaacagaaacgaccaaggtctcgtacacttacttcagtgtatgatgctattttggaagaccttgtgtttcctgcggaaattgttggtaaacgtattcgtgtgaggttagacggctcacaactcattaaagtccaccttgacaaaaatcaacagaccacaattgagcataagatgtgtttcgctaacaccgtagctttcttggtggacacatttgcatcagtatacaagaaattgactggaagggaagttactttcgaatttccagaaccctatttg

SEQ ID NO: 975 - DNA, 659 bp, Leptinotarsa decemlineata
tcacagatgaagagggatacggaaagtatttggatctgcacgagtgttatgaaaaatacataaatctaaaaggaattgagaaagtagattacatcacgtaccttggaatgtttgatcaactttatgacattcccaaagaaagaaaaagtggtgaataccgaaaatatttattatgtcttatagagtatttgatgtggtttgtccaaaggatcaagccattaatggatttagaaagtggtttacaggaagaagttgatagagttattgctacatgggaaagtggcacagtacctggatggcctaaagaaacgggttctgctttagccaatgttggtgcacatttggatctttctgcattttccagctgggaagaattggcttctttaggtctggatcgtcttaaatctgctcttatggcattagggctgaaatgcggagggactttggaagaacgagctcaaagattgttttcaaccaaaggaaaaggttctttggatccttctcttatgactaaaaccaataaaggaaaagctagcaaagaaaaggaacaacttcaattagttgctgttcagagaacagcaacaaaagagaatgtacaaagaaaacaagcacgcacagatggtgaacgtgatgatagcgaaaatgaagaaagtgatgat

SEQ ID NO: 976 - DNA, 419 bp, Leptinotarsa decemlineata
aggagcaccccgactacaaataccggccgaggaggaaacccaaaggacctctcaccagtggcttgaaacctgccatggggttccccatgccccagctgccgtacccttttccaggaatggattctctgagcagtccgtatccttacttcaaccctgcgttcgatttttcgaggatacaaggtataaaacacgaagaaccttcttacattcaccaccaacccgccgttatatcgtctccttacgcagtttctttgccaaattctttttattcctcgttctatcagcaaaaagctctgacgacgtctcctatgggtatgttctccacaatgccttcgacaatatactcgactacctcgagtccaacaacaactccatcgacctcagatctggaaatccgaagaccggttccggtgatgtac

SEQ ID NO: 977 - DNA, 1514 bp, Leptinotarsa decemlineata
ctgcagaaaatctatgcggagaacagaaaaagagcccaaaatgctcactctcaactggattcccttggccagaaagtcgagtggcctctctacaaccaacccagtgatgcgaccgcctatcaggacaacaaaaggaagcacgtgtctttcaaaagaaggctgttggagtactttaagcagaagcacaaggaaaacgagacaaggaacaaatttctgactgagacttacagcaaaatgatgcaagattggttgaggaaagtcgacaaaatagaatgtagcacgaagcgaaaagcaaaggacgtaaaaaatagggaatttttcgagaaagtttttccagaactgaggaagcagagagaggacaaagaaaggttcaacagagtggggtctcgagtgaagtcagaagctgatatggaagaaattatggataatcttcaggagcaagctctggaagataagaaaatgcgtagctatgcagtcatacctccgattcttttcgataagaaggcgaagcggatcaaatacgacgacaacaacggtttcgtcgaagatatggacgtcgtctataagagcagacggtttttaaatgtgtggactgccagtgaaaaagaaatattcaaggagaaatatcttcagcatccgaagaacttcggttgtatagcgtcatatttagatagaaaatcggtgtccgactgtgtacattactactatttgagtaaaaaaactgaaaattataaacaattatttaggaaggctaggcagcgaacgaggagctcgaggaataacacgcagaaggttagcaatagcgggaatgcttccgttgtggacatcttgacttcaggcgtaacaactcgacttcaaagagaacaacaggctaaaacgggaaatcaacagtctcgagatccgaatcagccgttggaacatccgacgtcgacgacaccgccagcaacatccgcacccactcccagcaccgcagtgtctgtcgacagccctccgtcgaccgttacgacgactaccaccaccacgtccacgtcaagcccggcgacgacaacctccgtactgccgtctacgccgccaccgtcggccgtttcaacgtcagataaaaccgtggtcggtggttcgatgacaccgacagtttctggagtgactactaccccgacaaccgcgatatcgaactgtatatcttcttctagtacatctgtgattacgactagcagtagtggcgcgatcgtgacggcgtccacggcgacgacgacgccgtccgtcgtcgtttcggcgtccgtgaccgtgacgacgatgaacgataaagaatcgactccgatggaggtggacacagttacggaagacgtgaaaccgaagacttttttggggtttggttcgatggacgagtacatggcgaagagcagttacttcgaagaggtcggcggttgcggaaccggcagcggtaaagacggcgcggctgtaattttggacgggcagaagcagaagagcgttgtggtggacggaactacgagcct

SEQ ID NO: 978 - DNA, 454 bp, Leptinotarsa decemlineata
atggaaaaaatttatactggaatcagtagtggcgaggttgctgctgcagtattttgtgatttctcgaaggctttcgactgtgtggaccacgaaatactgctgagaaagcttccttattacggtttcagaggagtgatactgagctggttcagctcatatttgtcaggtcgtagccagatggtggaaacaaaccaccgctcagaaattggagaaatacataagggtgtacctaagggttcaatactagggtcaatattgttcctcatctacttcaacgatttgacaagtaaattcacactattttcagatgatactactattttttggcagttggacaatgcaaacgatttaactaaaatcatatccaacgatatgatgacagtgaaaaattggtgtgattcaaatcgtctttctctaaatattttgaaaactgatatattttctattattttgc

SEQ ID NO: 979 - DNA, 409 bp, Leptinotarsa decemlineata
tattttctattattttgcatgaattcacaaatgaaccttcattttgctacaggtatggcatcgttgaagacatcgatatcaagagacctcctcctggaacaggtaacgcttttgcttttgtccgtttcaacacgctggacatggcccacagggccaaggtcgagctgtcaggacagtacatcggaaagttccagtgcaaaattgggtacggcaaagccacccccacaaccagaatctgggtgggaggcctcggcccgtggacttcggtaccgcagctcgagagggagtttgacaggtttggagccataaaaaaaatcgactatgacaaaggcgacaatcaggctttaatcctctatgacagcatcgatgctgctcaagctgctgtgaaggaaatgaggggttttccctt

SEQ ID NO: 980 - DNA, 884 bp, Leptinotarsa decemlineata
tgaggggttttcccttgggaggacctgagaggcggctcaggactgactttgctgatgtcactcctggagtgaacttcagacccaaggccccgtatgctgatgattacagaagggaccctgaaggagattttgactacaacgcagcatacagaagaggattccccgatagaggcagagggagtagcagagggccgtaccgctatcccgatggggtcgaggacgaatttggcagaatcagggatccagagtatgaccgcaggcgctccggatccaggggcgtggacagatccaggtcacgatcgcctaggcgctcgcccgattctgattctgacagtggttctcgtagagctggccttttagcctccagtcgtaccctgcccgaggtcgccagaaagtgcaacaccgtctggcagggggccctgatcctcaaaaactccctctttcctgccaagttccacctgatggatggggacactgatattgttgacggattgatgaaagacgaagacggcaagcaccagttgaggataacgcaacgtctcagactggaccagcccaaattggaagatgtgcagaagcgcatttctagtgccagttcgcacgctatcttcctggggctggccggttcgacagcgtccgtaactaatgacgacgcaaccgtccaaactcggcctctaaggaatttggtgtcgtatctcaagcagaaggaagccgccggagttatttcgctgctgaacaaagaaactgaagcgacaggcgtcctgtactctttccccccttgtcctttctctactgagctactgaagagatcgtgccccaacttgtcggaagaagccatcaaggaagatcatttgatcattgtagtggtacgtgggggtacagca

SEQ ID NO: 981 - DNA, 810 bp, Leptinotarsa decemlineata
atgtacaaagttttttttcagaaactactggaaccatttgattatatacttcaagtaccaggaaaaaacataaggtccaaactatcaagagcattcaatcactggctaaatatatctgaagagaaactaaaccaaatcactgatattgtccaaattttacataattctagtcttttgttagatgatattcaagacaattcgatattgagaagagggatacctgtggctcattcaatctatggtgttgctagtaccataaacactgcaaattatacttctttcattgctttggagcgagtagtagatttacaacaccctgaagcaatacctatagctttagaacaaatcctagagttgtacagaggtcaaggaatggaaatatattggagagacaatttttcctgcccaactgaacaggaatataaacaaatggtagttcgaaaaactggtggtctcttcatgttggctataagattgatgcagctttttagtgaaaataaagaagattataccaaaataacggcaatattgggattaatatttcagattcgtgatgattatttgaatttagtgtctacagattatatgcatcataagagctactgtgaagatttaacggaaggaaaattcagttttccaataattcatgccatttcaagtcaaccacaggataaacaggttatactttcgccccttaaagtcagatggcactatattcttcgccagagaaccaaggaagctgaagtgaagaaatattgcgtctctttactagagaaatatggtatctgcccactataccgtaccaaacca

SEQ ID NO: 982 - DNA, 535 bp, Leptinotarsa decemlineata
atgtatatcttgtacgaactggttcacaattttctgttcattcaattcaaatacactcggatcgtgtgtatcccaaagttagatgagtttgaagatgaggcgttgagtggattcctgatgatgatgacgcaaaatggaaaacttttgtacatatcggataatgctgctgagtacctgggccattccatggtgagtgttctacaggaggaccttttaatccatggagatagtgtatatgacataatagataagcaagatcaccagacaattcaatgtgaattgggacggccagtaaatacggggtctaacaataatccaaatgatgaaattcggctgtttttatgtaggatgaatgtttctaggaatgttaggagacaaatgcgatttggcgatcagaaggttgtattagtacaagggaggtacctatcgttccttcccctttgtagtcgtaatgaaccagtatttctggcatcgtgcacccctgtagccatgcccgaaacgagggagtgtgtagtccaaggtgccaccaacgtct

SEQ ID NO: 983 - DNA, 595 bp, Leptinotarsa decemlineata
gtgccaccaacgtcttcacatccatacactcgatggatatgaggtttatccacatcgataacaacggtgaattctacctgggctttccgcgctccgatctgcagggggtgtcctggtatcggctgctgcactgggaatgcacgcgtgaggcccagaccaaacatcgcttgataacccaatcggaacaagaaagatcatgcatcctgctggcgcaaattcaacggcgtacaggcgagtggatgtggatgcactgcgtgctgcaagtgaaagagagctcggaaagcagtcaacaacccgtaatcgtgtgtactaaccaagtcctcagcgatgccgaagcggctgtcatgagaacgaatagctggctctaccactactattccgtccagaataagctccaatacggtctcacttacgacgtcggtccttcgtcgcgactcctctactacccggagcggtcgcaagccccagagtttgccgcctcccacgacgtgagcgggtacgcgcatctgtcgacgatgcccgccgccctgcaaccccatctaagtcatcacagcgcgtccacgcacacacaccacaaccctcaccaccaccacca

SEQ ID NO: 984 - DNA, 525 bp, Leptinotarsa decemlineata
cctcaccaccaccaccaccgacgagctgactccgagccagtagattattcgtacagtaagcgcaagcccaaagaattacaaaacctcgaattagaagtaactgaccacgatgtgtctgatgctgatggaggtagcagcggcctgttggtaatatcgcatatgtcagaaaggccaaggacgctacttaaggtcgatcccagcgagctgatggaccagtggaaccccagtccgccttggtcggacaccttgcagaaggttcccgacttgtgtcaccaggaactcagtccctacatagggagtactccccctactccaactgcgacccccagcacgcaaaccagcgcattttccttcgactggatgccggaacaatacgtcccttcgatagcttcagctgcaccagctgaagacgccgaaagacaggtttactggcccacggaacatcgattatttccgttgcagcctcctccaaagaggaatcatccgcccccaggaagatctgagtcggctgatcgagacactcct

SEQ ID NO: 985 - DNA, 383 bp, Leptinotarsa decemlineata
aatacgagaaagcctattatggtacttcgttggatgccattcgatctgtggtcaattccggcaaaatttgcgttctgaatttacacccgcagagtttgaaaattctgagaacttccgacctgaaaccgtacgttgtctttgtagcaccccccagtctggaaaagttgaggcagaagaaaatcagaaatggagagtcttataaggaagaagaacttaaagacacaattgagaaagcacgagaaatggaagagaaatacggacacttcttcgacctgataattataaataatgatacagagagggcttatcaccagttattgaatgaaataaatagtctagaacgagaacctcagtgggttccagcagcatgggtcaaggcgccg

SEQ ID NO: 986 - DNA, 923 bp, Leptinotarsa decemlineata
acattggatatgatgattcgtccaaaggatttgattacaagacctgcaatgttttattggcattggaccagcagtcttccaatattgcggcaggcgttcacattaacaaacctgaagaagaggtcggagcaggcgaccagggattgatgtttggatatgctacagacgaaactgaagaatgcatgccattgacagtaatcctagcgcacaagttgaactacgagctagctgaattgagaagatctggtgaattctggtgggctgggccagattccaagacgcaggtcacagctgaatacactttggaacgcggtgcctgcattcccaaaagaattcacactgtggttgtttctgtgcagcacagcgagaaaatcactctggaggaattaagaacggctgtcactgaaaaagtcatcaaagaagtaatttccagcaaatatctagatgatcagactatcatccatattaatccatgcggcaatttcatcattggaggaccacaaagtgacgctggtctcactggcagaaaaatcatcgttgacacatatggtggatggggggcacacggaggcggcgccttttctggaaaagactttaccaaagtcgacagatcagcagcttatgcagctagatgggtggccaagtctttggtcatggctggcatttgcaagagatgcttggtgcaagtttcatatgctattggggtggccgaacctctatctgtttcagtatttgattatgggacatcgcagaagacccagagagagctgcttcagatcgtcatgaataattttgatctgagacctggaaaaattgtcaacgatttggatctgagacgacccatttaccaggagaccagcacttatggccactttgggcgtgataccttttcctgggagcagccaaaagtcctcaacctgaat

SEQ ID NO: 987 - DNA, 994 bp, Leptinotarsa decemlineata
ctggaagacctaaagttaaaatttgaaagtactattactattatcgataaagtttgtgggtggttgaaaataggatatcactttgttctgatttcaaaaagtgttattgtggtggtcgactgtataacaacattcaacatggctcttaaggcccaagttggtcaaaaaataatgaatgaagtcattaaacataaacctgtcaagaagaatggtcctgttgcacaacaacagtctcatggcgttgaatggaggatcttagtggtggatcaacttgccatgagaatggtgtctgcatgttgtaagatgcacgacatatcggctgagggaattactttggtcgaagatataaataaaaaaagggaaccgctaacaactatggaagctgtttacttgatcacgccttctgaaaaatctgttcgtgccctgatgaatgattttgaatcgcctcgatacatgtataaggctgctcacgtctttttcactgaagcatgtccagaccaattgttcaatgagttatgccatcacccaatagcaaaacacatcaaaaccttaaaagaaatcaacatagcatttattccatctgagtcacagtctgaaatttgtcacagtaaaattcgttctgaaaaactgtacctggaactcctttttagtgattgggaaagaaacgttgagcttgctcagttgattcagcagaaattggacgcatataaagcagatgagcccactatgggagaaggtcccgaaaaagctagatctcagttgatcattttggatcgcggcttcgattgtgtttcccccttgttacacgaactcacctttcaagctatggcatatgatctgttgcccatcgaaaatgatgtgtacaaatatgaagcatcagccggagtcctgaaagaggtcctcctggacgaaaacgatgaactatgggttgagcttcgacaccaacacattgctgtggtatcacaaagcgtaacgaaaaatttaaagaaattca

SEQ ID NO: 988 - DNA, 789 bp, Leptinotarsa decemlineata
aaaatttaaagaaattcactgactcgaaacgcatgacacagagcgacaaacagtcaatgaaggatttgtcgacaatgataaaaaaaatgccgcagtaccaaaaagaattgtcaaagtacgccactcatttgcacttggccgaagattgcatgaaagcttaccaaggctacatcgacaaactctgcaaagtcgaacaggatttagcaatgggtacagatgcagaaggtgaaaaaatcaaagaccacatgcgcaacatcgttcccattctgttagaccctaaaataaccaatgaatatgacaaaatgcggatcatagccttatacgcaatgacaaaaaatggtataacagaagaaaacttgtcaaagcttgccactcacgcccaaattaaggataagcagacaattgctaatttgcaatatctaggcgtcaatgtcatcaacgatggtggcaagagaaacaaaggttacaccataccgagaaaagaaagaatcacagagcaaacataccaaatgtcgaggtggacaccagttatcaaagacctgatggaggattgcattgaggataaattggatcagaaacactttccatatctcgtcggtagagctcagtccactggatatcatgctgcaccatcaagtgctcgatatggccaatggcataaggacagaggtcagcaggccgtcaaaaatgtaccgaggcttctagtcttcgtagtgggaggaatcagtttctcagaaattcgttgcgcttatgaagttaccaacgcccagaaaaattgggaagtcataa

SEQ ID NO: 989 - DNA, 283 bp, Leptinotarsa decemlineata
atgcctttactgatttatttctttatgaggaatcaaaattggttcaacagctattttcttctattttccaggcacgccccctcctcccctggcatgacttgccgggcctactccaacgccaccgattgggacatcaatgacagttccatcccccgaatcaacgagtacgaccctttttctgaatgggctgatggtcactgcaggctagtctacagagcggacagcgaagaagccaaaagacactcttcggggtgggccatgaggaacaccaacaaccacaacg

SEQ ID NO: 990 - DNA, 901 bp, Leptinotarsa decemlineata
acaccaacaaccacaacgtccatatactgaagaagagctgtctcggggtcctggtgtgctccctgaggtgcaccctgtcgaacggggataccgtccacctcaggccagctatctgcgataaggccaggaaaaagcagcaaggtaaaccatgcccaaacagacagtgcacaggtcgcttggaaatcttaccctgcagaggacattgtggctaccctgtcactcacttctggaggcacactgaacacgcaatattttttcaagccaaaggagtgcacgaccatcctagacctgaagccaaaagtacttctgaagcaaggagaaccttgggcagtggtagaagagtcagaggtctggctgttctattagcaaaagaagctgctctagggaataagttgatgtctttacgagaaccaaaacggcaatgcagagaaattaccaaccaagtttctagaagtatcaatacccctacactaatgtcagaggcagaaaaaggttactgttcctgtccaccattcgaatgcatctgcaactaccaacaaccactattgacgaccctcaaccagtttcccacgtctccttcaacatacccacaactgccagaaacctactggaccccagaaactactcatcagcagcactaccaaaccgacctggcgacactcaaccagcagtatgacttcaacagtatatctacagatctctttcaacctgaggaaatcttccaaatggaacaacctgtgaaacacgactacgccagtctagctcagaacagcgaagtcgccagaagtcccccgacgctgctggatctaggaagtggaacaatccacaaagagttcaaaaccgaagactactggcatcctactttaacgagcatgctgaatgacgacagcaacaacagcag

SEQ ID NO: 991 - DNA, 484 bp, Leptinotarsa decemlineata
cagcagcaacagcaacagtaggttcaatctcagtcaaagcccagacaccagtcaagtcttactgaacaacaacgtgccccagttggaccaaaatctgtacttagactccaagttggacgacaatcccttctctttaccaaaaactcagtattatcctcaaccaagttccttggagagcagttacagaccctccggctacgacctgactgaaagtaagcctacttactctggagaagataaaggcttccaggttttcgagccttaccacgcttcaaaggcgtataccaagtccaaccaagacgaatacatcgacctagggcagtacagcgagtacagccactttctcaacgtgtacgataacaacaaaatggcggaaagcgccatgttcaacgacctcgacttcagaatccagagctcttgcgtgccctctatcagcaatctgcatagctacagtcatgatacttttgatgtgatgtctcaccag

SEQ ID NO: 992 - DNA, 528 bp, Leptinotarsa decemlineata
atgggagcttacaaatacattcaggaattgtataggaattcgagtgtggcaatatcgccagttgacaaaactccaccgtattccagcacagtccagccgtcccgtatccttgtacgacgtgctggtcgtaaacgtcctgttccgaaaggagccacctatggtaaaccaaagaatcacggagtaaatgatttaaaacacatccgtaacttgcaagctactgctgaggaacgtgtaggaaaaacatgtggtggattgagagtttttaacccatactgggttgctcaggactctacttatgaatattttgaagttattctggttaacccatcacataacgcagtttgtcgtgatcacaaagttaattggatacagaatgctgtccacaaacatcgtgaactacgttgtaaaacgtctgcaggaaagtcttcacgtggttttgtcaagggatacagatattcccaaacaaagggtgcttggagacgagctgtctggctcagacgaaactctcagcaattgcgcaggaaacga

SEQ ID NO: 993 - DNA, 317 bp, Leptinotarsa decemlineata
ttgccatctgatttcatagttattttagcaaaatttgtatacagtgatagtaattttttaggttatgaacatttttattttcagatcaaaatgggtaaaataatgaaatctggtaaagtcgtattggtccttggaggccgatacgctggaagaaaagcagtagtcataaaaaattacgatgatgggacgtcagataaacaatatggacatgccgtggtggctggaatcgataggtaccctagaaaaatccacaaacgtatgggcaaaggaaaaatgcacaagaggtccaaaatcaagcccttccttaaggtgctcaa

SEQ ID NO: 994 - DNA, 412 bp, Leptinotarsa decemlineata
atgggtatcagccgagatcactggcataaacgaagatcaaccggaggcaaaaggaagcctctgcgtaagaagaggaagtttgaattaggtcgccccgcagctagtactaaactaggacctcgcaggatccactatgttcgtaccagaggtggtaatttgaaatatagggctctaaggctcgacactggaaattttgcctggggtagtgaaggaactgcgagaaaaacccgtattattgatgttgtctacaatgctagcaacaatgagttggtgcgtaccaaaacattagtgaagaatgcaatagttgttgtagatgccactccattcagaatgtggtatgagaatcattacatcctgcctttgggtcgcaagaagggagccaaactgactgccgaagaagaggctcttttag

SEQ ID NO: 995 - DNA, 1107 bp, Leptinotarsa decemlineata
atgcaactgaagcgacctttccggggaggtctcaaaaaggcctttggggtgatatgtgccctcttggtcgtgtacctgttggtacactcggttggactgataagttcagattttcccactatggttactgaccagaagtatgtcgttggagacgataagaaaatttacgaatataacaggcagatgccgcttattttcatcggcggtgttccgagatctggaactactctgatgagggccatgttggatgcgcatcccgatatcagatgtggtcaggaaacccgtgtgattccccgtcttcttcagatgcgattccactggctcaaatccgagaaagaatccatgcgattgaatcaggctggtattacaaagtcagttctcgattctgccatagcagcattcacgttggaaatcatagcgaagcatggcgagccagctcccagactctgcaacaaagacccattgacaataaaaatgggcacctacgtcatcgatctcttccccaacgccaagttcattttcatggttcgcgacggtcgtgccacagcccattccatcatatctcgaaaagttacaatcaccggttttgatttgaccgattacaggcagtgcctgaagaaatggaacagtgctgtggaagcgatgaacagccaatgcagggaactggggcctgatagatgtttgcgggtaccctacgagcaactggtgttgcatcccaagaaatggatggaaaaagttcttgagtttctggatatcccttggagcgattccgtgcttcatcatgaagacttcatcaataacggaatcgagctcagcaacgttaaaaaaaaggctctgtcaaaatgggttggcaatataccagaagacgtcataaaagatatggcccatattgctccgatgttatcagttctgggttatgatccttatgctaatcctccaaattatggacaaccagacgcagaagttgcccataaaacaaaggaaattcaaaggaacaaaaacgtttgggaaagaaaagccaaagaaatgtttgacgtcggttgggataatgctgatggagatactgctctagacaaagaaccgagtgataatcccaacaacattacg

SEQ ID NO: 996 - DNA, 372 bp, Leptinotarsa decemlineata
ccagattcatgtatgacagcttcgataatacttaccaagcaactataggtattgattttttatcgaagacaatgtatcttgaagacagaacggttagattgcagctctgggatactgcaggacaggaacgtttcaggtccctcataccttcttacattcgggactccactgttgctgtggtagtctatgatatcactaatgccaattcctttcaccagacatccaagtggattgatgacgtgagaactgagagaggcagcgatgtgataataatgctggttggaaacaaaactgacttgtccgataaacgacaagttagtacggaagaaggtgagaggaaagctaaagaactgaatgtaatgtttattgaaa

SEQ ID NO: 997 - DNA, 269 bp, Leptinotarsa decemlineata
catcaaacccgacaacatcttgatagacaaagacggccatatcaaactgaccgacttcggtctatgcaccggtttccgttggacccacaattcgaagtactaccaacctaacggagaccacagtaggcaagactcgatggatccgatcgacgactggaatgaagagtgcaagtgcaagagtctgaagcctttggagaggcggagacgccgcgagcatcgatgtttggcgcactctctggtcggcacgccgaactacatcgcacccgagg

SEQ ID NO: 998 - DNA, 485 bp, Leptinotarsa decemlineata
tgctggtgggtcagccgccgttcttggcgaatacaccggcagaaacgcagtacaaggttataaactgggagacaactctccagataccgaagcaagcgaatctctctaaagagagtacggacttgatacttaaactgtgctgtagtgcggacaaacgtttagggaagaacgcctgtgaagtgaaatctcacccgttcttcaaagacattgatttcgagaaggggctgcgacgtcagcccgctccacacaaacctcgcatagattatcctacagacacgtcgaatttcgatccgatcgaccctgacagacttcgtaattccacctcactggattccagcacgtcagaggaattcctagacaactcgaaactcttccacggctttttcgagttcacgttccggaggtttttcgacgacggaggcctggcggccttcaacaagatcaacctggacgacaacgacaatcaaggtgggcccgtctacgtg

SEQ ID NO: 999 - DNA, 618 bp, Leptinotarsa decemlineata
cctcagaaattggtcatcgctatgacctctgacagaggactttgtggggctgttcacaccagcgttgctcgttacattcgtggagaactcagcaaggatagcgaaaacattaaagtcgtttgcgtgggtgacaaatctcgagctatactgcagcgtatctatggcaaaaacatcattctggcttgcaacgaaatcggacgtttgcccccaaccttcatcgatgcctcaaagctagcagatgccatcttgaaatccaactacaagttcagctctggtgaaatcgtcttcaacagattcaaatctgttgtgtcttataatacacagactctgcctgtcttcagcttggcctctgtgacggctgctccgaaactttccgtgtacgattctttggatgatgaagttattcagagttacttggaattctcacttgcttcgttgttgttttattcaatgaaagagggggcctgcagtgaacagtcctccaggatgacagctatggacaatgccagcaaaaacgcaggagagatgattgacaagctcactctgacgttcaaccgtaccagacaggctgtcattactagagagctgattgaaattatttctggagcatcggcactg

SEQ ID NO: 1000 - DNA, 519 bp, Leptinotarsa decemlineata
atgttttatcatatatcccttgagcatgaaattttactgcatccccagtattttggcccacaactattagaaaaagtaaaaacaaaactctatacggaagtcgagggaacttgtactggaaagtatggatttgttatagcagttaccacaatcgatagcatcggagctgggttaattcttcctggacagggtttcgtagtctacccagtcaagtataaagcaatcgtttttcgcccattcaagggcgaggtacttgatgcagttgttcgacaagtaaataaagtcggaatgtttgcagaaatagggcctttgtcctgcttcatttctcatcactcaatcccagcagagatggaattctgccccaatgttaatccacagtgttataaatctcaggatgaagaagtagtgatacacgcggaaggagaaataagactaaaaatagttggtaccagagttgatgcttctggtatttttgccattggaactttaatggacgattacctaggtttaataagtaat

SEQ ID NO: 1001 - DNA, 381 bp, Leptinotarsa decemlineata
atggctgaagaagtgaatccgaaagcttatccattggcagatgcaacccttactacaaagattctgaacctcgtgcaacaagctatgaactataaacaactccgaaagggtgccaatgaggttactaagactcttaatcgaggaatttctgaatttattgttatggcagctgatgctgaacctttagatatcctgttacaccttccgctactttgcgaggacaagaatgttccatatgtgtttataagatctaaacaagctcttggtcgagcatgtggtgtttctcggtcagttattgcttgtagtgtaaccaccaatgaggggtctcaactgaaaccccaaatacagacaattcagcaagaaattgaaagacttctagtt

SEQ ID NO: 1002 - DNA, 819 bp, Leptinotarsa decemlineata
atgagtttagcagagatctgtggaatgcaagatttagattcatttaggacgaacttctgtcccaacgagttggatagaatgtgcaccaatttcgaaaataatctgaatctggaaatgcctccttttgcaaatccagcagcaaaggtatcacaattaacgagagatgaaagcggtcgagaaataaaaatggcttttgatcatggtaccacaactctgggtttcatgtataaaggtggtgttgttcttgctgtagactccagagctacaggcggacaatttattgggtcgcaaaccatgaaaaaaattgtggaaatcaatgatttcttattgggaacattggctggaggtgcggcagactgtgtttattgggaccgtgtactggccaaacaatgtagaatgtatgaattaaggaacagggagcgtatttctgtagcagctgcttccaaattgatggcaaacatggtatacaattacaagggaatgggactgtcaatgggaatgatgttagcaggatgggataaaagagtaaactccgagggtaccagaacacctggaaaagtctttagtgtgggttcaggttcaatttatgcatttggtgtcttggattccggatacaaatgggatttgacggatgaggaggcttacgatttgggtcgcagggcgatttaccatgccacacacagagatgcctactctggaggtatcgtgagggtttatcacatgaaggagactggttggatacatattgataacaatgattgtaatgatttacattataagtaccaggctgagaaggaagatttggaaaatacaattgct

SEQ ID NO: 1003 - DNA, 262 bp, Leptinotarsa decemlineata
atgaaaacaggacagttatacaaaaaactctgcatgacatttgtgttgaaatgggctactgaacttcgccttttaggtcagcaattatgtgtaaatgaatgtaaaacacatttgtttcgttttccatgctctgcttttatccgagtagtgggatctgaatttgttcaaaagtaccttggagaaggaccccgtatggtacgagatgtgttccgtttggccaaagaaaattctcctgccattatattcattgatgaaattgatg

SEQ ID NO: 1004 - DNA, 224 bp, Leptinotarsa decemlineata
gtcgtttggataggaaaattgaatttcctctgccggaccgtagacaaaaacgtttgatattcagcactatcacatcaaaaatgaatttatctgaagaggaaaaaataatgataggttgctatataaataaactatggtccaaaaatgttcccgttacaaaaatacgacgtgttgaagttttaacaaagaaattaaaccatttgggatattttagtgatatttgg

SEQ ID NO: 1005 - DNA, 564 bp, Leptinotarsa decemlineata
atgatttcagttctgaacataaggtacaacgattatgctggagaatcagtaccttatataaagatttctcacagaagaaaatccagtttattcgtacagcaaatgacttggaatgagaaacgaaatttgcacatgcccgtattcgatattcagtttcatctattttctggcgtttacgagttcaagcagataaaacaagaggccgacagtacctctcctctcctcactcctccacatacccccacctatcccaatatgtcacctcccttggctaatatgtcctgcgaaacttggtatcgttcggaacaaatggagccgtcgtttcatcactacccagtgatgcaatcgtatcccacgtacaacgttgttttcatgaatcaatggttgaggaatgcagctatttaccatgccagaaatcagttccaagatatgagaatgccgaacagaagccccgtgggacccaaggtggtgggatctgcaagacctaaaaagcagtttatttgcaagtattgcaataggcagtttacgaaaagttacaatttgctgatacatgaaagaactcac

SEQ ID NO: 1006 - DNA, 259 bp, Leptinotarsa decemlineata
atgaagttgcattcgaatatttacgttggtgacattgaaagagaatcgattggacttccgccagggcctgcaactgaaaacaacgccaaccgtctcacaattttgacagctcttttacatccgtgcaacagaacttgcaaaaggcgcaatggaggacgttcaaaacacggccgaggtcatgtaaagccagttcgttgcaccaattgtgcaagatgtgttcctaaggataaagccatcaagaaatttgttattcgtaaca

SEQ ID NO: 1007 - DNA, 236 bp, Leptinotarsa decemlineata
aatttgttattcgtaacattgttgaagctgcagctgtaagggatatcaccgaggcttcagtctatactcaatacgttcttccaaaactttacgccaagctacactactgtgtttcgtgtgcgatccacagtaaagtagtacgtaatagaagcaagaaggacaggaggatcagaactccacctcagagaaatttccctggacgagacaacaatcgcgctcagcaacaacagagaaaa

SEQ ID NO: 1008 - DNA, 541 bp, Leptinotarsa decemlineata
agtcgcctgcgtttgtgaggtactccaacaagcgggcaacgtagaaagattaggtagatttttatggtcgttaccagcatgtgataaactgcataacaacgaatctgttctcaaagcaaaagcgatagtagcgttccataggggaaatttcaaagaattatataggatactggaaagtcacacgtttagtccccacaaccacgccaaattgcaggccctgtggctcaaggcacattatatagaagcagagagattgagaggtaggccgttaggagcagtaggaaaataccgcgtgaggcggaaattcccccttccaaggaccatatgggacggagaagagactagttattgtttcaaagaaaaatctaggagtgttttaagagactggtattcccacaacccctatcccagcccgagggagaaacgagaattggccgaagcgacggggttgacgactacgcaggtttccaactggttcaagaacagaaggcagagggacagggctgcagagcacaaagacaggtatttcattgactatcat

SEQ ID NO: 1009 - DNA, 338 bp, Leptinotarsa decemlineata
aagaaaaagaccaagaagaaaaatttagatgagctaatagctgaagcagaggaaaaagatgatgatcaggagaatgttgatgataattcaacaatatgggccggatctgacagagattacacctacgatgaattgttgaatcgtgcctttgaaattatgagggataagaaccctgacatggcagcaggaaagaaacaaaagttcatgatgagaccaccacaagtagtcaagattggcgccaagaagacttcatttgccaactttacagaaatttgcaaaatgttgcatcgtcaaccaaaacatctgttggactttttgctggctgaattgggtacaag

SEQ ID NO: 1010 - DNA, 275 bp, Leptinotarsa decemlineata
ctgaattgggtacaagtgggtctgttgatggtaataaccaacttattatcaaaggacggttccaacagaaacagatcgaaaacgttttaagaagatatattaaagaatatgttacgtgtcatacatgtagatctcctgataccatcctccaaaaagacaccagattgttctttttacaatgtgaaacgtgtggatcacgctgttcagtagctagcattaaatcaggttttcaggctgtcacttccaagcgtgcggcgattcgagccaaaactgca

SEQ ID NO: 1011 - DNA, 2554 bp, Leptinotarsa decemlineata
atgaaagaactcaacactaaaatgttcaaaatgtattttctaccaataaattacagatatacaaacgaaaatgtacttctcattctattcactattacattttctaaagctccacgaaagaaacattcacttggaaaaaacgagattgccacacgaatggtttctgtcaaacccataaaaattgatactattgtattcaaatgtagctacaaattgttcaaatcccctcagggaagtaagtgccccaccccgggctgtaccggtcaaggacacgtcacagggctctattcccatcatagaagtctgtcgggatgtccgcgcaaagacaaggttacttcggaaatccttgccctacacgagaccatcctcaagtgcccgaccccgggatgcaacggaagaggccatgttagttcgaatcgcaactcccaccgcagtttgtcaggttgcccagtagcagcagcgaacaagcaagctgctagggaacacaagtatcactcgagcttgggcagagtcaaatcccccagcagctcccctttcggcggtggtgctcaaagcgaattcactcaaagctacgaaagcaagaggtctcctacttcggaagacgttaagcccaattatttggtttatgggaatccttcgacgacgtcagctgatgacaagcctacttacgaccaattttacagttccaaaacgaatcctatcaagccagatccgatgaaagtcccaaaatctgaattaactgctagtaattgttgcaatgttgctggacaaggagaacttctagtaccaaaaacagaaatgccaagttcttgcagatcacctccgtcgggaatgagatcagcctacgaaccctacataaatcaagattcaaattcttcttcgatgtcaagtatggacacgatgaactcgaggggtccacatcaaattcaccacaccgctcctcacatgggtccccatcacaatccccaacaaccagggtacgtatttgtttccgtcatagttatcaaaatctcagtgatatacaatatggatcatcaaatgcctcaccgatctccctaccatcagtcaccaatgtccgaagaaatgtatcacagggagcgatcctacgctgaaatgagcgattcaatgggaagtgctatcgctagaccagtagtcacctattccaacgaaatagttaatagatcgtacgattcagctttaataaattcggccagtcacaggccgtatgatcctggtaccaccagtttcgaaaggtacgactctagccaatgtgtttctcttcaacaacccttgggacctccaagggtaccaccacagggtatgtacgggtatatggaagagcatccggagcaaaggtatcagcaagaagccgcagctgttcaacagcatcaactagcagtagcgaacgcacaaggattaatgaaaagcgaagagcaagaatcaagtggacccctttatcccagaccaatgtatcagtacgatgctacgagtggcggtccccttcctgtgggcttttcagcaattaacttatctgtgaaatgtgtgacaacggcccacgctcaaatgaaggggccacatacgtctcccgggggctctgtggcgtacagttcaccgcactacggtggccaaagagtcggaggcagcccacaagcggcggccagtccccacctctcggcgagcccccaggtgcccagcccccagggccagacgctggacctcagcgttagcaggctgtcccacagcagcgatacgaacccgcaataccaaaacggccacagtgaagctgtaccggtacaacctcgtccgccccccggctactcgcccccgcgggatgaacaaatggaacctgtcgatttctcaaccgcaaatgaacccaccgttaatttcagtggcgtgcggcctgtggcgaccttcgcttcaagcgctggcggcgggcccgtcttggcgcctggctccggctacagcagagaatccacccccgacagcggaggcagccactacatggatgcctacagggatccagcaggttatggtccaatgagtccgcacccaggttacggtatgactacagtggcgagcgattattcgtcgaatccatacacaccataccccacaggcggttattcatgtgccagcggatatccgggagcggtgacaacaggatatcctgtgcctcccggtggatattctcccagcacttgttattcgatgcctccacctcagcattccctatcgcagcacgataagtcgccaaataaagacagtttgtctggttgccctagagcagatcgttcccaaattcaagcacactcacaagagttgaaatgtccaacaccaggttgcgatggctctggtcatgtaactgggaactattcatctcatcgaagtttatcgggctgtcctagagccaacaaaccgaaaagtaaacccagagatggtcaggactctgaaccattgagtgcttctggctgtccaattgccaaccgaaacaaaatgcgagtcctggaaagcggtggttcagtagagcagcacaaagcggcagtagcagcagcca

SEQ ID NO: 1012 - DNA, 616 bp, Leptinotarsa decemlineata
ggcagtagcagcagccactgctatgaaatttgagggagtcaactgtccaacccccggatgtgatggaacaggccatattaacggatcgtttctaactcacaggtcactcagtggatgtccagtagctggccaaagtatcaaaaagtctaaatatcctgaagacatgccgttttatgccaagggatatacaggtatagaacaaggtcccaataatggtgaagacctcatgactttggaagctgaaatttcagaacttcagagggaaaatgccagagtggaatcacaaatgataaaattgaaatcggacataaatgccatggaaagccatcttggacatggtgaaaaggaaacgcaagccctcagccaacgaaccaccaacctgaacgagtactacgaaagccttcgcaacaacgtcatcaccctcctggagcacgtacgactgccgggaggcggggtaatgactcaagagaaaatcggccaagacaacttcgattcctacttgagtaaattgcaaacgctttgcacgcctgaagggtactgcagtgacgagaacagaccattgtatgaaactgtgaagtgtgcattgcaggattttactgtgttgccaacgcctata

SEQ ID NO: 1013 - DNA, 659 bp, Leptinotarsa decemlineata
atgtcccagaacgcggtggtgacagccgcaaccatatgctgcttcatttgcctgacttggacgtcaccaacagccgcccaatccaactatgcggatcaggccaacaacatcgagtaccgaggggaaggtctccccgaacaggccactctagacggaaaggtcaccaaactggacgaccttagccccgtgattttcctcaatcgaacgaaggcagctctgaactgcgccgccggctccatgcaaatcgaactgaaattcaacgacaagttctacggaatagcgtatgcgcagttcgacaggaattctgcgtgcaaggtgttcggaaaagggcagcacagctacaagttggagttgccattgaaggggtgcggtaccatacaagatcctcagcgtgttttcaccaacaacatcgtcgtgaggcaagaaactccagcagcagcaattgcgcctccactgaaaggtttccaaattcttctaataatatgtggcatactatttctgtccctgcttctacttggtctaggatgctcctattactgcttgagaagacgtccagtcaccatcatcagacagccattttcatctattggaagtggatcggaaatcaccaaattatctggaagctctctaggtaatctctcaatgtttgagggagtgaa

SEQ ID NO: 1014 - DNA, 2175 bp, Leptinotarsa decemlineata
atgtttgagggagtgaaaatcccgcgagcgaacgtccctcccgtaatgggagcaccaggaagcagtgcgggaagcgaaggtccactgatgagcgacaaccttccttccgactacccctcagagtcccattccgaaatcgacgtagacaccggatctttaccagtgtcttcggcaggaagttacgaaaatcaagcataccttcacgataacagtagcttttatagcgaaggatacggccaaacccaagaacagcaagttcaaaacgcaatcacttcttcagcaacagtacccaggctacctttggccgtcaaagatcaaccgaggttcgacgttcaagtccgagtgaagaaagctcctccttcgcctccgagtatttcaatgtccgatacggaaagcacaagaactgatagaaatctttcgacaatcccagagcaacgagaagaaagcgtcagatctctcgactcgcctcttcctttggaaagaactcacttcacgtacattcccgagcttcatcatcctcctaaacatattcaacccgcgccgacgtacaatagaattctcagaaggcagctggagatgcaagaagaaccaatgagggtggcgcctccaagatctatagcctcgctcgatactgaaatgaccgatacccactccatgacggaaataatggatgattcccatcacaagttcctggctcccactcctccgcctccacctcctatagtaccgaaacaagaatatatccgatatcaggaagaaccaacttctttggagcctcccattgcagtcgtgcacaaacctgaagttacttcccatgttgtcgatgacgtattcctaagaacaatcaccgaaaagaaaaccatcgaagacattgagagacacagacgattggtaactgaataccataccagaccgaaacccaaacctgtggaagatcagaaatgggatgtgaccattaaaaactacccggtggaaatgcctgaaccgccagaatgggaaaacttttccgatatatcctcagcttccggattgaccctcactccacgactcgaaagagctactatgagtttaccgcctcaaaatacaatcatcgacgataagttaccattgaatgcaccagagattgtagccaatataggacagcagccgcccagatactccgcttctttggacattcctcccagtgagcagagtttcttgtcaactttcaatatccccatcgaaaatcctgatgtccccaactggaacgtgctcatcagagttttccatcccactgagcatgaagagggcccagtgatcgaaagcgccgaaacattcaattcccaattgactacgtccgataaaatgaagtggcgtcagataataacgacagaatcaacacttcgcactctcctaacggaatgtgtcgttcgtgaagattacgagcgcgtcagaagcgactccagatacgtgaaccttttcgaacctccaaagtgggacgtcatcatcaaaatactttcgcccccagacaaaccaccgaagaaccgcaaaaagagaaacgactgggacaacagaagccgccgcagcagcttgccaaccctctacgagtacgattccgatgggggaagttcagtaaaaactctaacgagggaacctcttgtacttcctctacactcgcagagatccagaaagaattccagatcgagctatcgcagcgaagctgatctgaggtccatgtcagaaatgactgtcgacttcggccgtccagacaacttttcggaaacgtccagctactatcccgataagagatattacgatgactccgaaacaggtcatccttccttggcgaggtcactgagtcaaccgagtttggctcgatctgctagcgagttcacggagagatgggttgctccatctagatacgatacagctagcgaattcacttctcccgaagtaactccaaagtctcagaggagcacaaggattcagcctctagatctgcaaagaggtggaggaggacagagaacgatgtggcaagccagccaggctagtagctcagttcaagggccactcgtttcttcacaagtggttactcaacagttcagaagtgaaacttctaccagcttcatgggtcacggtccacgacccacgggccatggctggtttgcagataatgacagcgaagctagttataaa

SEQ ID NO: 1015 - DNA, 265 bp, Leptinotarsa decemlineata
atggccccaaggtacgaaatcgccgttgggctccaaaggggacacaaaaccacaaaaatcgacaaaaagatcaacaaagttcgtcccgcgaggttgaaggggatccaaacaaagcacacaaagttcgttcgtgatattatccgagaagttgtaggtcatgccccttatgagaagagagccatggaattgttgaaggtttcgaaagataaaagggcacttaagttcctcaagagacgtcttggcacgcacatccgtgccaagagga

SEQ ID NO: 1016 - DNA, 658 bp, Leptinotarsa decemlineata
atgttgggtgctgtggcaagggcaagttctagccttttggctggaaaaactatcgaaaagattggagcagactctcttaaaatagtgtcatcatacaatgtttccagcaggaattatgctgctaaggccgcagcctccggtaaaagtgctggtaaagttgttgccgttattggtgccgtagtggacgtccagttcgacgaagaattaccacccattctcaatgcattggaagtacaaaatcgaactcctagacttgtgttggaggttgcccaacatttgggagaaaatacagtacgtaccattgctatggatggtaccgagggtattgttcgtggacagcaagtgaatgatacaggctaccctatccgaattcctgtaggtgtagaaacattaggaagaatcatgaatgtaattggggaacccattgatgagagaggtccaattcccactgataaattggcttccattcacgctgaagctccagagtttgttgatatgagtgttgaacaagaaattctagtaacaggaatcaaggttgtggatcttttggctccatatgccaaaggaggaaagattggtctgtttggtggtgctggtgtaggcaagactgtactcattatggaactgatcaacaacgttgccaaagcccatggtggtt

SEQ ID NO: 1017 - DNA, 213 bp, Leptinotarsa decemlineata
aatatttccgtgatcaagagggacaagatgtattgcttttcatcgacaatattttcagatttactcaagctggttcagaagtatctgctctgttgggtcgtattccctccgctgtaggttatcaaccaactctggccaccgatatgggtagcatgcaggaaagaatcaccaccaccaaaaaggggtccattacttctgtacaggctatctatg

SEQ ID NO: 1018 - DNA, 408 bp, Leptinotarsa decemlineata
atcctgctcctgctactacttttgctcacttggacgctaccactgtattgtcacgtgctattgcagaattaggtatctaccccgctgtcgatccattggattccacctcacgtatcatggatcccaatatcattggagcagaacattacaaagtagctcgtgatgtacaaaagatccttcaagattacaaatctctacaagatatcattgccattttgggtatggatgaattgtctgaagatgacaaactaactgttgctcgtgctcgtaaaatccaacgtttcttgtcacaacctttccaagtagccgaggttttcactggtcatgctggaaaacttgtacctcttgaagaaacaatcaaaggattccagaaaatccttgcaggtgactatgatcatttgccagaag

SEQ ID NO: 1019 - DNA, 641 bp, Leptinotarsa decemlineata
aaaaacaagaagaagaaactgctcctactgaattgctgcaaagacctaaagattatttggttaaattcagattcccagaaccaccacctctaccaccaccagttttaggattacacaatgtcacctttggctatccaggacaaaaacctttactagttaaaacagactttggtattgatatgaatagcagagttgccatagtgggtccgaacggtgtaggaaaatcaacttttttgaaattattgactggagaccttagtcctatcagtggagaaaatagaaaaaatcacagattgcgaatcggtcgatttgaccaacactctggtgaacacttgacagctgaagaaaccccttcggagtatctgatgcgtttattcgatttgccgtatgaaaaagctaggaagcagcttggaacttttggcctggctagtcacgcacacactattaaaatgaaggacctatctggtggtcaaaaggcaagagtggccttagctgaattgtgtctcaatgctccggatgtgctcattctggatgaacctacgaataacttggatatcgaatctatagatgcactggcagaagcaatcaatgaatatacaggaggtgttataattgtatctcacgacgaacgtttaattagg

SEQ ID NO: 1020 - DNA, 312 bp, Leptinotarsa decemlineata
ttgggacgtcttctatcgggcggagcaaaaggaccaggaatattcttcattttgccgtgtatcgatgcctatgcgagggttgacttaaggacgaggacctacgacattcctccgcaagaggtcctgacgaaggatagcgttacagtctccgtggatgccgttgtctactaccgggtatcaaatgccactgtgtcgatcgctaacgtggaaaatgcgcatcattccacaagacttctcgcccagaccaccctaaggaatatcatgggccagagaccactccacgaaattctcagtgaacgtgaaagcatttct

SEQ ID NO: 1021 - DNA, 495 bp, Leptinotarsa decemlineata
ttgcaaaaaatggcatcgaacctagcagcggccggaacagatccgaaaattaaagaaataataacgtctttagatgacgacaaaatagatatgttggctgctaccagtgttttgcagcaaagggcaactgacatcaggaatcagcatgttaactggcagtcttattttcagtctcagatgatatcacaggaagactataacttcattgtagcttttgatgtcacagatagcgctaaacgagaagcacttttgcaaaaggatcgtaatcagtgtgcccagacctttttgaatctgttgggacatgtttcaaaagatcaaacattgcagtacatcttggttttggtagatgatatgttgcaggaaagtagaagccgtgtggagatctttcatgaatatgccaataaaaagaaagaatcagtttggggaccattcttgaacctacttaatcgacaagatggattcattaccaacatgacatccagaatcattgcaaaa

SEQ ID NO: 1022 - DNA, 574 bp, Leptinotarsa decemlineata
tccagaatcattgcaaaaatcgcatgttggtcccatactccgatggaacgatctgatttgcacttctatctgacctggttgaaagatcagttgaaaactcagtatgaagctttggccgcttcgcaaccaactttagataccttgaagggagctgcaactgaacattactcggaatcgtcgttcgatcaacagtcctccccgcaaacgatatcgaataatgagtacattcagtccgttgcccgatgcctacaaatgatgctccgcatcgacgaataccgctttgcctttgtctccgttgatggaatttccaccctcctatcggtactgtctggtcgagtcaatttccaagtacagtatcaactcatcttctgtctgtgggtgttgaccttcaatcctctgttggccgagaaaatgaacaagttcaacgtcatccctatcttggcggacattttgagcgactccgtcaaagaaaaagtaaccaggatcatcctggccgtgttcaggaatttgatagaaaagcctgaagatcaacaggtagccaaagagcactgcatcgctatggtacagtgtaagg

SEQ ID NO: 1023 - DNA, 548 bp, Leptinotarsa decemlineata
ctatggtacagtgtaaggttttgaaacaattaactattttagagcaacgtaagtttgacgatgaagatgttaccggcgatgtggagtttttgacagagaagttgcaaagttctgttcaggatcttagttccttcgatgaatattcaactgaggtcaagtctggccgtttggaatggtctcctgtccacaaaagcaagttctggagagaaaacgcacagcgcctcaacgagaagaactatgaattgctccgcattcttattcatctgttggaaaccagcaaagatgctctggtattgagcgtagccagttttgatattggagaatatgttcgccactatcctcgtggaaaacatgttattgaacagttgggtggtaaacaattggtaatgcaattgttaggtcatgaagaccccaatgttcgttacgaagctcttttggcagtacagaaacttatggttcacaactgggaatatcttggcaggcaacttgaaaaagaacaaggaactgattcaggaccaaaatctgccacgcctgttgcaggaaaggca

SEQ ID NO: 1024 - DNA, 526 bp, Leptinotarsa decemlineata
ccagcagtcccatcacatgcatcaccacaaccaatcaccattcacgacaccgtcgcctccctctcccccgatcaggcactccatccccacctcagtcatccaagcagctaccagtagtatatacgacgatccctacatgctgggtttctccccgagaaagctgaagaaagttaaaaaacaaaagcttggagaacccggaacggtgaaaaggaaaagcagggagggatcgacgacgtatctctgggagtttctgctgaagctgctccaggacagggaatactgcccgaggtatatcaagtggaccaacagggagaagggagtcttcaagctggtagattcgaaagccgtgtcgaggttgtggggaatgcacaagaacaaacccgacatgaactacgagaccatggggagagctctgagatattactaccagaggggaatcctagcaaaagtagacgggcagaggttggtgtaccaattcgttgaggttcctaaggacatagtggaaatagattgtacaggagcagcg

SEQ ID NO: 1025 - DNA, 697 bp, Leptinotarsa decemlineata
atgcagaatatcgaaagtaagtcgtctggactcaaaaagagggaaagtagatcaaaatctatggagaaagaagaaacaaaacatggaaaaaaacggccgagaaaatcgagatctagatctcttgaaaatggccaaggaaagaaaaaatcacaagattatgatgatcttccaaaggactatccaagatattatggtgaagatcggccaaatagtgacagatattggaataagtatccaagaaaagataacataaaagttggtcagagatattatgaagctggatgtgagaagaaagaaaaaaaacgagaggagaagccagccattgataaggaacctgaagacaaatctgttataaaacctcgagaaagaaaaacagtggatctcttaacttctaggactggcggtgcttacatcccccctgcaaaattgagaatgatgcaggaaagtattactgataagtcttctgctgcttatcagcgcattgcatgggaagctctcaagaaatctatccatggatatatcaacaaaattaatacatccaatattggtataattgccagggaactgcttcatgagaacatagtaagaggtagaggtctgctatgtaaatctatcattcaggcccaagcagcttctcctacattcaccaatgtttatgctgcccttgtagcagttataaattctaaatttccaaata

SEQ ID NO: 1026 - DNA, 627 bp, Leptinotarsa decemlineata
attctaaatttccaaatataggtgaactcttattgaagaggttagtacttcaattcaaaagaggatttaaacaaaataacaaggtcatctgtatatcagccacaacatttgttgcccatttggtaaatcagaaagtggctcatgaaattttagcattggagattctcactctgctggttgaatcaccaaccgacgattctgttgaagtggcaatttctttcttgaaggaatgcggacaaaaactcacagaggtatccagtaaaggtataacagctatatttgaaatgttaagaaatattcttcatgagggaaagttggaaaaacgaattcagtatatgatagaagttatgttccaaattcggaaagatggcttcaaagatcatgcagctgtcttggaagaactggacatagtggaagaggaagatcagttcacccacttgattaccttggaagatgtgaagcaagttgatactgaagatattttgaatgtcttcaagtttgatgacaagtatgaagaaaatgaaggaaagtacaagacactcagcaaagagatactgggaagtgatagcgagtcagggtctggatctgaaggttctgaagacggttccgaagacgatgaagaagatg

SEQ ID NO: 1027 - DNA, 835 bp, Leptinotarsa decemlineata
tgaagaatgtgctcacaaactcctaaaaatggaactcaaaccaggacaggaaatagaactctgtcatatgtttttagattgttgtgccgaacagcgtacatatgagaagttttatgggttattggcgcaaaggttttgccaaattaataaaatttatattgagccttttcaaaaaatttttaaagatacatatgccactactcacagacttgatgccaacagactaaggaatgttagtaaattctttgctcatttactgtttaccgatgcaattagttgggaagttttagaaataatgaaactcaatgaagaagatactaatagttccagtagaatattcattaaaatcctctttcaagaacttgcagaatatatgggccttgggaagttgaataccagactgaaagatgaaactcttcaggagcattttgctggtttgtttccaagagatagtcctaaaaacacgagattttctattaatttctttacgtctattggtcttggaggattaacagatgaactaagggaacatctgaaaaatattcctaaaaacactgaattgaatttagcagttgggaaagaaagcagtagcagcagtagctctagcagttccagcgaaacaagttctgaagaaagcagtgatgaatcatcaagttcagaagatgaaaagcagaatagaagaggaaaagtttataaaaagaaaaatgaaatagagagaaaaggtgatcatcatagtaccaagaaaaaagaaagatatacctcaaaagatgatcacaaacaagaaaatgagagacataacgattcaagtgatagaagaaaaaaaaaagattatgaa

SEQ ID NO: 1028 - DNA, 226 bp, Leptinotarsa decemlineata
atggacggtcacattcctaaagtaaggttagttatcatggcactcaataatactgccaagcttttgagagttttcaacaaaccagcaaacttttcctgtgcaacctaccacaaaaatgttattgagcactatgaaaatcccagaaatgtcggttccctggataaaaacgataagaacgtcggcacaggtctagtgggagctccggcttgtggagatgtaatgaaac

SEQ ID NO: 1029 - DNA, 275 bp, Leptinotarsa decemlineata
gagatgtaatgaaacttcagatcaaagttgacagtgacggtaagatcattgacgctaaattcaaaactttcggatgtggctcagccatagctagcagttccttcacaaccgaatgggtgaaaggtaaaactgtcgatcaagccctcaaactcaagaacacggaaatagccaaagaactttcattgccaccagtgaagctccactgttcaatgttagcggaagatgctatcaaagccgctttgtccgattacaaaataaaacagaaaaaagaaaac

SEQ ID NO: 1030 - DNA, 865 bp, Leptinotarsa decemlineata
atgaagatgcgcgcccctaccccctccgagccgaaatctacatttcctacctaccaagtgcctcaaaagtcagccatgaggggcagcgcacccccagtacaagttgattggacagcttggggggatcgagccgatcccccaagtaatacccattgcgtctcaagtgacgccttttctgtgatatccggctcaagttgtcgttcactaggcaactctaatattagaatgcaatctgtgaccgaaaattgtcttctgaactctgttaccgaaccaaaaatacaacgtatagaccatgacatggtcgcccacaataatagatttaagttagttaataagtttggtgctttactccctggacgagacattcccaatcaaaagtctgatgacctcgaactatctgacgacctcaatgtactgaaatctgttaattgcgatatgataaacaacgataaaaaagaccgtagagtgtgccacctcagtaaggatgaatctgatttgtgcacaaagaatgacactgctttgcctttaaggttaagagggggaggtgaaagttcattgagtaccggtacctctggctggggtactcctccttcccaacaagccaacaacaatggaaataaatcaaatggacaacagccccctacttcgcaatccaacaactctggttggggccaacctggttccaaaccaagtaacaatactatgcctactactagtcaacctccagcatcctcttctgtttctcagaacagtgtgccaatcagtaccaccaagcagcaattggaacaactcaacagtatgagggaggccatatttagtcaagacgggtggggtgggcaacatgtcaaccaggatactaattggg

SEQ ID NO: 1031 - DNA, 213 bp, Leptinotarsa decemlineata
accaggatactaattgggatgttccaagtagccccgaacctcctttgaaaatggatggtactagtggtcctccaccatggaaaccagcagtaaacaatggaactgagctctgggaagctaatctacgaaatggtggccaacctccaccacagccacagcaaaaaaccccatggggtcataccccttctacaaatattggtggaacttggggtg

SEQ ID NO: 1032 - DNA, 2822 bp, Leptinotarsa decemlineata
cttggggtgaagatgacgatgctgatagctctaatgtgtggaccggggtaccgtccagtcaaccacagtggggtactggtggaaataccaataatggtgcgctatggggaggtcccaagaaagaaaacgactggaatgctggtacaaataatactggatggggagatcctagatctgcagatccacgtcaaacaggattagatcccagagaaattcgtccagaattgagagagatgcgcccaggaaattcagatgccatgcgcttgctggatccaagagatcagatgagacaaatggctggtaatgatatgagaggagatccaagaggcattactggaaggctgaatggagctggaactgaagctttctggggtcaaagtacgtcccatgcaggttcccaacaaatgcatcatcataacaaaatgcctgttgctccaggaaatactgcaggttgggatgaaccttcaccaccttcacaaagacgaaatatgccaaactatgatgatggtacttcactttggggtaatccccaacaagggtctcactggaaagatttgccaacaggaggaaatatgggtcgaggcaataataccgcaggtcccccaggcatggcacagacacgtatgaagccagatggttctgtttggggtcatgggcgcaatggatcttgggacgaacctggccaaacgccaacatgggaagaaccaggctcctgggctaaacagaagattccgggtccattatgggatgaacctgagtggggacataagcaggccaataaacctccattgactaaagagatgatatggaattcaaagcagttccgaatgcttgttgacatgggttataagaaagaagatgtagaaaatgctcttcgaatacgagatatgaatattgaagaggcactggaacttctcagtccgttacgaaatagagatggatggggaatgcgacatgatgatcactatgaccattcaccatttaattgccaaagatttcctccaggtcctagtgctcaattgcccggttttccacaaggtggaaacactcccaatcttctcaataatatgaacaattctggagcaaataactctctaataaacaatatgccacctgccttcgttcaaaaaatgcttaatcaaggaagtgggtcacaaggttttggaggatcttctgccaacgctggaagaaatctacatccacaaacacagccttccactcagcaactcagaatgctggttcagcaaattcaaatggccgttcaagcgggatacttaaatcatcagatcctcaatcaaccattggcacctcaaacgttggtgcttttgaatcaactgttgcaacaaatcaagacattgcaacagctcaatactcaacagacaattgccacaacacactcaatcaacgggaaaccaaacagcgcctacatgcagtgttcagtactgataactaaaaccaaacaacaaatagcaaacttgcagaatcaaattgctgctcaacaagccacttatgtcaaacaacagcaacaccaaagtagtttgggtgtctacgaatcctttaaagccaatacaatgcatgattccataaattcattacaaggtaactttgctgatctcggaatcaaagatccccagatgagtcagcagcagtctcgacttactcagtggattaataaagacaaagaagaaggaaatgaattcagtagagcacctgggtcatcttctaagcctatgactacctctcctaatatgaatccacttggactcaatccaacagatggaccgtggtctagtggaagaactggagatactggctggccagattctggcaccgatacttcaaatgatgtgaaagatgcacagtggtcaactgcctctcaaccttccctgactgatctcgtacctgaattcgaacctggaaagccctggaagggaaatcaaataaaatcaattgaagatgatcccagtatcacccctggttcggtggtgcgttcaccattgtcaattgcaacgataaaagataacgagttgttcagcatgaatcctgttaaaagccctccagtcactgatagtattcaatctttgagtctcagctcgtcaacatggagcttcaatccatctgcctcatcctcttcgaatgctttcgccagttcccagagtaaacttcctgtatccaagggaggtttagtggatttgaatcctaccacagccgttacctctgaactctgggctgcgccaaaatcgtctagaggtcctcctcctggtctctcaactaaaggtggaagccttgtgaatggctggtcaggcaatactgtaccatggggtggaagtcaaagaagttcaggaaattggggaggatcatcccaatggctactactgagaaatttaacggcacagattgatggttctacattacgcacactatgcttgcaacatggaccactgttaagttttcatctctatttgcatcaaggttttgctcttgccaaatactcatctcgtgaggaagctatcaaggcgcagactactttgaacaactgtgttttgggcaacaccacaatattagctgaaaacccaacagattgggatgccaatactttgttgcagcaagttgctagtcaacaaagtggaacttctggtgcttggaggagttccagcaaaccaacagctggtgccgacacatggagtactggttggccgaataatccttctacggctagtttgtgggcagctccaccattagacaatactgaccctgctagaggaactccgtctagtctaaattcatatcttcctaatgacttattgggtggtgagtccatg

SEQ ID NO: 1033 - DNA, 379 bp, Leptinotarsa decemlineata
atggctccttggtatgaattaatttgtaaggactctggctggaaagtggatcagaacttattgaaagccatgaaaatgaaaaatgatgaacaaataaaacttttggatgaggccattgaagatgctgaaaaaaacttaggagaaatggaagttagggaagcatatttgagaaaggcagagtacttcagtcgaatcggtgataaagataatgccgtgagcacatttaggcaaacttatgataagacagtttcgcttgggcacagactggatattattttccatttaataagaataggcttattcttcatggatcatgatctcatcactagaaatattgaaaaagcaaaaactttaatagaggaaggtggtgattgggata

SEQ ID NO: 1034 - DNA, 728 bp, Leptinotarsa decemlineata
aaggtggtgattgggataggagaaatcgcttgaaagtatatcagggtgcttactgtatggcagtaagagattttaagactgcagcaaacttgtttatagacacagtcagtactttcacatcttatgagttgatggattataaagcatttgtccgctacacagtttatacatctatcattagtcttccaaggaaccaacttcgagataaggttgttaaagggtcagaaattctggaggttcttcattctgaaccatttgttaaggattatttattttcactgtacaattgccagtatgcagaattcttctcaaatttagcggaagtagaaaccactctcagaaaagactacttcatgaatcctcattatcgctattatgttcgagaaatgaagattttggcctacacacagttactagaatcatatagatctctcaccctacagtacatggctgaagcttttggtgtttctatggaatacattgatcatactgataattacgagaaattaaatcaattttatgggatcctactggtccaacttcactgtaaggcaatagagttgtcaacattcattgctgcgggtcgactacattgcaaaattgatagagttggaggaattgtggaaaccaaccgtccagatctaaaaaatgcacaattcaattctgttgttaaacagggagatttgcttttgaatcgagtgcaaaagctgtctcgtgtcattaatatt

SEQ ID NO: 1035 - DNA, 220 bp, Leptinotarsa decemlineata
atgactgggttcagtgaaaaggccattctcatcgatggcaggggccatttgttgggccgccttgctgctatcgttgcaaaaacacttctgcagggcaacaaagtgactgtagttaggtgcgaacaaatgaacatatcaggaaatttctacagaaataaactcaaattcctatcatttcttcgcaagcgttgcaatgtcaatccagcccgtggtccattcc

SEQ ID NO: 1036 - DNA, 406 bp, Leptinotarsa decemlineata
ccgtggtccattccacttcagagcaccatccagagttttctggaaaactgtgagaggaatgttaccccacaaaactgagagaggaaaacaggctcttcgtaaattgaaagcatacgaaggaattccaccaccttatgatcgtaggaaacgtgttgtagttcctggtgctctgagaattatttgtcttaaaccaggacgtaagttctgtcacgtaggaagattgtcccatgaagttggatggaagtaccaatctgttgtacgcactttggaaactaaacgtaaagttaaggcagtgttgtccattcgtaaacgtgacaagctgaagaaaatcactaaagctgcttctgaaaaagtcgcgaagcagacaaaacctttcacagatgttattaattcttacggttataac

SEQ ID NO: 1037 - DNA, 482 bp, Leptinotarsa decemlineata
ttccaacaaatgtcatttctatcaccgacggacaaatcttcttggaaacagagttattttataaaggtatccgcccagctatcaacgtaggtctctctgtgtcaagagtcgccggttccatgaagctagaattggctcagtaccgtgaggtagccgcatttgcccaatttggttctgatcttgatgcagctactcaacaactgttgaatcgaggagttcgtttgactgaactgttgaaacaaggacagtatgtgcccatggcaattgaggaacaagtggctattatctactgcggtgtaaggggacacctggataaaatcgacccatctaaaattactgtttttgaaaaacagttctcagaacacatcaagagcagccaccagaatattttgcaaagtattgccaaagagggtaaaattacagaagagacagatgcccaactcaaaaaagttgttcaagacttcattgctaattttgctgga

SEQ ID NO: 1038 - DNA, 1568 bp, Leptinotarsa decemlineata
ttgtgtgttttgttgcaaaaatacagcaacatgacgcagcagttgcttcctataaagttccaggaacacttacagctcaccaatgttggtatcaacgctgccaacatcacatttgccactctcaccatggagagtgacaagttcatctgcgtgagagaaaaggttggtgaaatatcccaggtggtcatcatcgacatggctgatacgtccaatcccatccgtaggcctatcaccgcagagagcgcaattatgaatcctgcttcaaaagtcattgctctcaaaggtatcggtaaggcaggtgtggaaacacaaaaaacactccaaattttcaacatagaaatgaaatccaaaatgaaagcacacacaatgtccgaagatgttattttctggaaatggatcagccctaacactttggctttagtcactgaaacatccgtataccactggtccatggaaggagattcgactccacaaaaaatgtttgatagacattcctctttgaacggttgtcaaatcattaactacaggacagatccaaaacaaaactggctacttttggttggtatcagtgctcaacaatctcgagtcgtgggagctatgcagttgtactctgtggaaagaaaatgctcccaaccaatagaagggcatgccgcctcttttgccacctttaaaatggagggtaatcccgaaccatcgactctcttctgtttcgcagtgaggactctgcagggtggaaagctgcatattatcgaggttggtcaaagtcctgctggtaaccaaccatttcccaaaaagaccgttgatgtatttttccctccggaagcacaaaacgacttcccagtggctatgcaagtttccgccaaatacgatgtcatctatctgataaccaagtacggatacatccatatgtatgatattgagagtgccacatgcatatacatgaatcgaatatcgagcgaaaccatctttgttactgccccacatgaagtatctggtggtattattggtgttaatagaagaggtcaagtcttgtcagtttccgtagacgaagagagcataattagatatgtcaatacaattcttcataatgcggatttggcgctacgtatggccatccgtagcaacttagcaggtgcagaagaactatttgtcagcaaattccagatgcttttccaaaatggacagtatgctgaagcagcgaaagttgctgccaacgcaccaaaaggtatcttgaggactcctgctacaatccaaatgttccaacaagtgccaactcaagctgggcagaatagtccacttcttcagtacttcggtatacttttagaccagggaaagctgaatcgatacgagtctttggaattgtgcaaaccggttttgttgcaaggacgaaaacagttattggagaagtggttgaaagaagataaactggaatgttctgaagaattaggagatcttgtcaaacaagctgatcctactctcgctctatctgtctatcttagggccaacgtaccagccaaggtaattcaaagttttgctgaaactggacagtttcaaaagattgtcctcta

SEQ ID NO: 1039 - DNA, 869 bp, Leptinotarsa decemlineata
tcaaaagattgtcctctacgccaagaaagtatcttatactcctgactacatattcttgcttcgccaagttatgcgtacgaatcctgatcaaggagcagcttttgctggtatgctggttgctgacgaagagccattagccgatatcaaccagattgtagatattttcatggagcagaacatggttcagcagtgcaccgcattcttgttggacgctctgaagaataacaggcccaccgagggacatttgcagacaaggttattggaaatgaatctgatgtcagctcctcaagtagctgatgccattcttggaaacaatatgtttacgcactacgacaggccacatattgcacagctctgcgaaaaagccggtctgttgcaacgagccctcgagcattacactgatctgtatgatatcaaacgtgcagttgtacatactcatctcctacccgcagattggttagtcaacttctttggcacactgagcgtcgaggacagcttggaatgtttgaaggcaatgcttactgccaacatcagacagaacctgcagatatgtgttcagattgctactaagtaccacgagcagctaacaacaaaggctttgattgacttatttgagagtttcaaaagttacgaagaagtccatttcaaatacatccaagcagcttgcaagacaggtcaaatcaaagaagtagaacggatttgcagagaatccaactgttataatcctgaacgtgtcaagaatttcttgaaagaagccaagttgaccgaccaactgcctctaataattgtctgcgatcgtttcgacttcgttcacgatttggttttgtacttgtacagaaattcccttcaaaaatatatcgaaatttatg

SEQ ID NO: 1040 - DNA, 2397 bp, Leptinotarsa decemlineata
atatcgaaatttatgtccagaaggttaatcccagtaggctaccggttgttgttggcggcctcttggatgtcgattgttccgaagacattattaaaaacttgatacttgtcgtgcgaggtcagttctccaccgacgagctggtcgaagaggtagaaaaaaggaacaggttgaaattacttcttccctggttggagagtcgagttcatgaaggttgtgtagaaccggctacacacaatgctctagcgaaaatttatattgattcaaataataatgccgagagattcctcaaagaaaaccaatggtatgattcacgtgtggtaggaagatattgtgagaaacgtgatcctcacttggcgtgtgtagcatacgaacgtggtcagtgtgatagagaactgattgctgtatgtaatgagaactctttgttcaagtctgaagctcgttatttggtgcgcaggcgtgatggcgaattgtgggctgaagtacttcaagagagcaacccatacagacgtcagttaattgatcaggttgttcagactgctctgagcgaaactcaagatcctgaagacatttctgtaactgttaaggcattcatgacagccgatctacctaatgaactgatagaattgttagaaaaaatcgttcttgacacctctgttttctctgaacacagaaatctacagaatcttctcatccttactgctatcaaagccgatgccactagggttatggattatataaatcgtttagacaactacgatgctcctgacattgcgaacatcgctattaacaatcatttgtacgaagaggcttttgccattttcagaaagttcgatgtgaacacctcggctattcaagttcttattgaacaagtgaacaatttggatcgtgcatacgagtttgcagaacgctgtaatgagcctgccgtttggagtcagttggccaaggcacagctcaatcaaggcttggtcaaagaagcaattgactcttacatcaaagccgatgatccctctgcctatatggcagtcgtcgagactgcctcccaaaacaacagctgggaagatttagtacgctatttacaaatggccagaaagaaggcaagagaaagctacattgaatctgagctcatatattcctatgccaagacaggtcgcctagccgatctagaggaattcatcagtggtccaaatcacgctgacatacagaagattggagatagatgctttgatgacaagatgtatgatgctgccaagttgctttacaacaatgtatcgaactttgccagactagcaatcactttggtgcatctcaaagagttccaaggagcagtagatagcgctcgtaaagctaatagtacaagaacatggaaggaggtctgtttcgcttgcgtagatgccgaagaattcagattggctcagatgtgcggaatgcatatcgttgttcatgccgatgagttgcaagatttgatcaactattatcaggacagaggatatttcgaggagttgattggattgttagaagctgccttgggactagaaagggctcatatgggcatgttcactgagttggctatattatattcgaaatataaaccagccaagatgcgggaacatctggaattattctggtcgagggttaatattccgaaagttcttagagctgctgaacaggcacatttgtgggccgaactagtatttttgtatgacaaatacgaagagtatgataatgctgtcctggctatgatggcgcatccaactgaggcatggcgtgaaggtcatttcaaggatatcattacaaaggtggccaatatcgagctatactataaagcaattcaattctatctagattacaaacctttgctgttgaatgatttgttgctggttcttgctccaaggatggatcacactagggctgtttcattcttttctaaaacaggtcacttacaacttgtgaaatcatatttgcggtcagtgcagaatctaaacaataaagcaatcaatgaagctctcaattcactccttatagaagaagaggacttccagggtttgagaacatccattgacgcttttgacaatttcgacaacattgggttggcacaaaagttagagaaacatgagttgacggaattcagacggatcgctgcttatctctacaagggaaataacaggtggaagcagagtgttgaattgtgcaaaaaggacagacttttcagggatgctatggagtatactgcagaatcgaggaatcaggaattggccgaagaattgttggcctggtttttagaaaggaaggcctatgactgtttctcagcatgcttatatcagtgctacgatttattacggcctgatgtcattctcgagcttgcatggaaacacaaaataatggattttgccatgccct

SEQ ID NO: 1041 - DNA, 256 bp, Leptinotarsa decemlineata
ggattttgccatgccctatcttattcaagtaacaagagagctgacgaccaaagtagagaaactagaacaatctgaagcagaaagacggaacgaagctgctgaagaaacgaacaaacccatgatgatacccgaacctcagctcatgctaactgccggtccaggaatgggcataccgcctcagcaatatgtgccgccccaagcgtatcctcaacctggttatgctccccaaatgccctaccaaggttatcctggcatg

SEQ ID NO: 1042 - DNA, 1629 bp, Leptinotarsa decemlineata
atggatataagcaacgaagacgccaacatccaccgtttgtttgacactgaagttatagatctcactgatgaagttagttttatagttgtttgtccatctgcagaattttcctgctctgttccggggcaaagggaaattcttctccaacgaggggatctactcagtttgccacttcaggtttttgaaatgatccatttaaacacctatcagaacagtattataagaaagtattccaaactcagctgcctcttggaactagatgccgcaacagcaagccacttacatagagaagccttctccaatagcgaagtagcgatagccaaagaacggttaactaaattacaggaccttcaaactaagctgaatactatctggaaaagcgtcaggtggttgatggaagtaatttcttttgctagagatcgtgttacttgtggaatgagtatgaggttcattctggagaaagaatctggcatgtgtactagtccaaaacgaagtcttttgcagattcctcctcgcgatacaaaatcagtgaagagtactccaggtagaggttcatggccggggccaggggcttctaatattactccaggaggcagtcttatcaacgaattcagtaaaagtgaacaacacttgagcacaaacgaaaacacgcaatacctcagtgcttgcagcgatccagagtctcgaaaaaacagcgacagttacaacagtgattacttcagccagaatttacctccgtcacgtagtgaagacatgctttttagcattccaactagtaccactcaacaacgttttcgaaccaacactatttcaagtatttctgctactaccagtcctatgctgggtactaggtcgctacgttctggaagcatgttgagtgtcaatactctcaatacgaccaacacttcagatagtatgcatagttttagttcagatagtgatgattgtttacaccctatgagctcatcgacgccaaacagaagacatagatcaaaaatggtaccatcaaagagcatgagtaatgttaaacagaatattttggacataagtacgaggtcagagagaactagaccaaagcagttaaacttcgatccaaatatgttgcactcaaatttagaatcgagtttatcgaaaagcctgagtaatatcaaatcattcacagacgtagattatccttcggctacgtatcttaaacctatggatctcttaagacctccagagagtgttgacaacttcaaaataccggatgtccatcctcagtccagctccaaagatctcgcaagcggaatacttcaggtttatgctgcctacgaaacaggcctggccactggtaccagcctgaagctgcacgtcactccaagaactacagcacgcgaggttgttgatctcgttgtgaaacagctcaacatggctgtggtactaaaaggaaaagaaggtcctatttataacattgataaactcaaaaacttctgtttagtcgctgtaattggtgctagagaacgttgcttaagagatgatttcaaacctttgcaactccaaaatccctggaagaaagggaggctctatgttagacagaaacatgatgttctagctgctctcgagcatagtagcaaacacagcacaattatt

SEQ ID NO: 1043 - DNA, 393 bp, Leptinotarsa decemlineata
atgcacttggcaagtgaagtgtcatccaccacaggtcactacgaccgtacttatggcaacttgacagccgaaatgctcgcagagaggaccatcgatgggctccttgcggaacatcctggtgaactggtgaggaccgggtcgcctcatgtagtttgtactgttttgcctccccactggaggtccaacaagacgttacctgtagccttcaaggtggtcgctttgggggatgttggggatgggacggtggtgactgtgaaggcggggaacgatgagaacttttgtgcggagttgaggaactgtaccgctgttatgaagaatcaggtggcgaagtttaatgatttgaggttcgttgggaggagcggaagagtcagatggtggaaacaacccatcgct

SEQ ID NO: 1044 - DNA, 407 bp, Leptinotarsa decemlineata
aagaaagggagagagaggataatgagccagagtataagtttgaatggcagagaaaatacaatgcacctcgtgaaagttactgcaaaggtgatcaagaaattcgtgatcagccctttggaattcaagtcaggaatgttcgctgtatcaagtgtcacaaatggggacatattaatactgataaggaatgccctatgtacagcttgtctatgagtgctgcaagatctttggaaaatgctacagtcctcgaccagaattctttagttcagcaaatgcttgatgatggtttagctttaaaaaaacagcatatcaatacaaccgaagctaataaacacctgctagtgaatgaagatgtagaagaaaattcagaagtggcttttataaaatctttaacaaaaaaacaaaagaga

SEQ ID NO: 1045 - DNA, 218 bp, Leptinotarsa decemlineata
acaaaaaaacaaaagagagcattattgagaaaactggaaaagctagagaataatttaaattctaattcaaaaaataatgatgagtatagtgacagggaattatcctcggatgaagacacccgaaagaaacctaggtctagaactcatatgaaaacagaagaccggtataagaatgaaaaaaaaagaagtaagagtaaagagaggaagaggaaaagaag

SEQ ID NO: 1046 - DNA, 666 bp, Leptinotarsa decemlineata
atgttagatatacgtcaactgtatttcctaaaggttaccatttatcaacactttagaaaatatgagctcctagccatagaacaccaccacaacactaggaggaaagccgatgaggtccaaatattggaggagacgatacgagcccgaaacgaacaacagaaaaaggccggggtggagctggacgctacatgtcacatttgtctcaagaccaagttcgcagatggcgtcggacatatttgtaactattgttccataaggtgctgcgccagatgtggtggaaaagttacactcagatctaataaggtaatttggatatgcatcctttgccgaaaaaagcaggagctcttgagtaaaacgggtcaatggatgttaggtgggccaaacccagaaacggaccttccacaaatccagcaagcgccctcggacaaacgaccgaaactagaacgagcgcactctgccgccgaaaaggaaaatctaccgttgcaaaggtcgggtagtgttttgcgtagacaatattcagagcaagaacctagagccccttcttgcgaaaggtatcaacagtataatgaggaagatcccaggttttaccaaggagaactagagggccttatgagaacgcatccgcatttggttccaagaaggtttccgaggaagaccagtcttgat

SEQ ID NO: 1047 - DNA, 280 bp, Leptinotarsa decemlineata
ttggaccgcgacttggtggacaccatctcctcgatataccccgagtggttcaggaacaacatggcggagggaggaggccctccttccagcccccggacttcccctccgaaagcggtcgtcgacacatcgcccatcatgatcgaccaaaacaaagaatccctgaaggtgaagttgctgctgcgtcggccgttcgaccagctggtcgcccaaggaatcatgcccccacacaagacacccgccgcctttcatggccagcgccgtcaactggaacgggcgaaga

SEQ ID NO: 1048 - DNA, 908 bp, Leptinotarsa decemlineata
tggaacgggcgaagaccggcgacatgctaaaagcgaaaatccagcagcgcccgcctcggcaagagctcgaacggcgccatatcctcgaaatcgaccctagtcacgtggacccgagcatagccgagcggcaacgcatgctcaagaaggccaaactggccgatcagctcaacgaccagctttcgcatcggcccggcccgctcgaactcatccagaagaatattctacataccgaggagcccatcgaggaggcggtcaagaccggccgaatcccgtacaaggcgacctgcgagggccagctccacaggccacagctgccctcaaactacgtcaaccccgaggaggactcgcagagctccgaaggtgacacccgcgtcagcccgagtccgacagatgtgctggagacagcggccaaatcggcaggtatagtagtctccttgatacaaccgacggaagggacgtttgtcgtaacgacagcaaccgcgcccaaagacaataccgaaatcgtgttcgcggacctttgcagatccgtcgccgcgcccctgatctcggcgacaagccccgcctctctctgcacttcctctacatcctccctgagtcccctctcgtccgtcgctagtccggtgccttcgatcgtatcccaaccggcgacgccggcgccccctccaccgcccccacctatctccctcataaccagaaccctgccctcgcccgccaagagcgaatcctccggcaaggataaaagcaggaagaaatccaagctgaagtccgtcccgaagacacgcaccatcaaattccacgagtacaaaggcccgccaagcgcccacaagacttccgcttccagcttgaaccccgaagagagctcgtacgacctgctgctgaaacagcagacgctgctgctgcagttccag

SEQ ID NO: 1049 - DNA, 421 bp, Leptinotarsa decemlineata
gctcgaagccgcagctgatagagagactgaaaccgttcgcggcgggtgacgttgtcaaccaaaaccccgcctctatagactcttctgcacacagcaatgccagcgtggatcagtcgcataactcgcctgtctaccaggacatagactcgccctatgacaccaccaaggacgaacaaaccgagcacatggaactcgacccgacgagcccttcgcctcagcagattcacgagcaattcgttcagaaccaagagcagaaagccaaggaggacatcgtacgcgagcagcagagacagatcgaggtgctccagagagagttaactctgtcacagttgaaactgcaggccgcgacgaggtccgagccgaaggcgcagatgatcgcactgcagaagcacctgcaggcccggcaacagcagcaacagca

SEQ ID NO: 1050 - DNA, 1055 bp, Leptinotarsa decemlineata
agcagcagcagcagaacttcgctctgcaaatgaagcagctgcaggcgctgcaagcgaggcaagcactcgtgaacgaagagcagcaaaggatacagcagcagatctcgttgcaaaaccagaagaatatcgccggcggattgattttgaatagcgctgacgcggctctcgtcttcaaccagttgatgcagcagggcaaggcgaaaattctcaacgggcacggcaggagccagtcgtcgccaaatttcctcaattcgatagtaaccccactgattaccgccccagatgtcaaagcggactacatagaggatcacaagccgactcccgagatcaaaatcgagttccgggatcagatgaagccgcccccgccacagtacaacgaagccaccaagcagatgaataagaagaaccacatcaagagtcaaatcgtcgacgacgtcttggagattttaataaagaacggtgaactgcccccgagtgctgccaatgatcccctgacgccaaactcggcaggtaccaagtccaccgaacctatctatccttcttctccgcctagcgacaaccacaataaccgcatcgaaacccacgtcgacatcaacgatgctctggacaacatccacgcaagtcacaacaacgaatcgatggaggagcctgacagctcggaaaccgctctggagatagacccgactgacctgctcgaaacgttggataatctcgataacatggacttctcgcagctggtcatggagctcggcggttgccacacccccgtcgataacaacaactaccatggggaaccgatgatggacgacgatatggctatggacaccgacgactggctggaatcgctgctccccagcgagagctccgagtataacggcaacaacggcgtttccaccaccaccgcgccgttagctgtccctgagagcgatctaagcggatacgatcctttgttaggcatcgcgcacgacccctacgatcctttcaatctggaagacttccgatctgcgtctgatctgacggccgcgctctcctgggacaaggttgactacgccacg

SEQ ID NO: 1051 - DNA, 476 bp, Leptinotarsa decemlineata
tgaacaaaattcaagtggggtcggctccttcaccaaatctgaaggtagtgaaatctaaaatcggttctctggaaaacgctagttataaacctggaggagggaaagtcaaaatcgaaagtaagaagttggacttcaagtctgctgcgcccaggatagaagctaagaatgaaaaatataccccgaaaggtggagaaaagaagatagtacagcaaaaattgcaatggagcgcaaaatcgaaaataggctcgttggaaaacacaactcataaaccgaaaggcggagacaaaaaaatcgaaactgtgaaactagatttcaaggggaaagcgaagccaaaagtagggtccaaagacaatatcaaacacgttccaggagggggagatattaagataattgattttccttgctgttctcataatatcagaggtgttacttatattgctgactatctcatttttacaattctacaaccgttagcc

SEQ ID NO: 1052 - DNA, 212 bp, Leptinotarsa decemlineata
atgcctctgatggggcatatcaagaaaaaagcgaaggaaagagaagctgagaaaaaagctttcggaggtgtcgatgtgttctctatgaggactcctgaagacttgactggtcgagatggtgaattgattttgctagaattttgtgaggaatatcccccattaatgaatcaagttggaatgtgttccataatcaaaaactattataagaggaa

SEQ ID NO: 1053 - DNA, 587 bp, Leptinotarsa decemlineata
aaactattataagaggaaagctgggaaagactctggtcctcctacatatagatacggagagactgtctatgctcgtacttctccgtttttaggtgtattgctcccgggtcagtccatccaagctatagaaaacaacatgtatcgggctccagtttatgaacataatattccagaatctgatttcatagtcataagaactcgacggcagtattatattcgggaaatggattcgatatatcttgctggccagcaatgccctttgtatgaagtgccagcgccaaactccaaaagggcaaatgattttgttagggactttcttcaggtttttatatatcgtttattctggagaagcaaagataaccctagaaaaataaaaatggacgatattaaaagagcctttccctattattccgagaacagcattaggaaaagattgaagctttgtgctgacttcaaaaggacaggcttggattcgaaatggtgggttatcaaatcagaattcagactaccaaccgaagaagaaattagagctatggtatctcctgaacgttgttgtgcatactttagtatgatagctgcaaagcaac

SEQ ID NO: 1054 - DNA, 355 bp, Leptinotarsa decemlineata
tgatagctgcaaagcaacgtttgaaggatgctggctatgccgaaaaattcactcccgcggaagatgatgatgaagaaatacaattgaaaatggaagatgaagttaaagttgcaccttggaacactactcgagcatatattcaggctgtgaagggcaagtgtctccttcagttgactggacctgctgatcctacaggttgtggggagggtttcagctatgtcagaatctccaataagccaactcagaataaagaacatgaatctcaaccaaaaagggctgtaactggaaccgattcagatttaagaaagttgtctctaaacaacgccaaagccttgttgagaaattttggagtttc

SEQ ID NO: 1055 - DNA, 1224 bp, Leptinotarsa decemlineata
agaaattttggagtttcagaagaagatattaaagagctcacacgttgggaaattgttgatgtggtgagaacactttctacagaaaaagctaaagctgggggagagggaatggacaaattttccagatgtaacagactttctatagctgaaaatcaagaaaggtacaaaaaagaatgtcaatgcatatttgacttgcaaaatcgagttttagcaagtgctgacgtactgagtactgacgaggaagagagttcggaggatggaagtgatgaagatatcgaggaaatgggcaaaattattgaaaatatgttaaataacaagaacacaagcacgcaccttacgctagagcgagaagagctagaaagacaaaaattgataaaaatgatggagggcgctaaagatagaccagaagataagaagaaatgtacagaagtaaatgatggccaacgttacccgcaaggccgagtattgagaatagttcgtacactcaaaacccgtgaaggcgaggagtaccatagacaagaaatcgttcgaaaccaagctgtgatagacgcttacgttaaaatccgtaagtcaaaagatgaagctttcatccgacaattttcttcttcaaatgaagctgaaaaagaggaattgaagaaagaaaaacgtaggattcaagataaattaagaaggattaagaaaattcaagaaaagaagggaacggctggtggtcatgtgcagactacaccaattgttagtttaccgtctgcaaactctgctcgtgtcacacctacgtcgagcaaaagtacaactccctcgctccccaagtcatcaaggaagactaaacacatgactgactcaaaatgtgggttaacaggcatgagtactgctataaatgttgctatgacagataatcaagagagatgtattgcaaatcaactcaacactggtgatgaagagataaaacatgaaggttcaatgctaaaagtgcctagaaacgatctgtgcaataagaagagaccgcgggaaatctctgattcacactgtgagggattggcgaaaaggagacgaactgttccagttgttcggttgtccgatctgcctttacgagcagttgaagaatcacatcatgaaaccgcaatgaagttatatgatgatttagcattgagtgaaagtgacgatgaagtttccaatactcctcaagagcctatgcaggaagattatgatgcagacgatctttggttt

SEQ ID NO: 1056 - DNA, 542 bp, Leptinotarsa decemlineata
agcacatgcagaaacacgccgagagaacggacaaaaggccgcctatagggcctgggctagggctgaaccaccgcggtctggaccacccctactggcccaaagtgagcccagatagcgcagagaacatgcacgactaccccaacgatattccccgtcagattttggagcagaacgaagacttggtcatcatcaggcagcagcttggtcagaatcctcccgcccctcctggtacacccaacacgaacctgggaaattcctacgacacgtcaatttcgaaatcaaacactaactcagcattcactccgatcaattccatgtcgggtcacttgaacctcaaccatcatcaactggccccaaacagaccttacatatacgatgctttgagtttccagaaacagaatagtttggatataccgaagtcgcagccttctaacggattccctaaccagctgatcagcttgcatcagataaggaactatgctcaccagccaaaccctacatccttgatggagcattctatcttagggttaggtaaagataag

SEQ ID NO: 1057 - DNA, 453 bp, Leptinotarsa decemlineata
atggatcaacagttttgtctgcgctggaacaaccatccgacaaacctgacggacgtgttgagtagcctcctgcgcagagaagccctatgcgacgtaactttagcctgtaacggcgaaacgttcaaagctcaccaaaccatactctcggcgtgtagtccatatttcgaaacaatttttatacagaatgctcatcctcaccccatagtttttctcaaagatgtcaattacaacgaaatgaaagcactgttagattttatgtataaaggagaagtgaatgtttctcagaatttactaccgatgttcctaaaaactgcggaggccctgcagattagggggctcaccgataacaattctctgagtaaaaatgaagaattatcagaagtgccaagaagagacagggatagattagttgaaagagacagccctccaagtgaaaaacgaaaaagaaaatca

SEQ ID NO: 1058 - DNA, 930 bp, Leptinotarsa decemlineata
aaacgaaaaagaaaatcatcttcgaactgtgatatgacatcaaactcaaactctgaaagatttaacgactctcaggccactcaaaagttaaacactagcgtaccaaagttgaatcccatatcgccggtcgatagggaaaatagttcgggtgcggaggatatgcgtgtatcctctcctgtaataaagcaagagccgatgcacgactccagcccgcttatagattccttccattcaatgtcagaagcattgcaaacgacaaaatcgtggggaagagatggggacgtagaaactctaccagcggctcggttaccacagcattcagctttgcgtcagtacctaacagcgccacctttgagtcaatcgccgaaggacttcacgtactcgaacactatcggggatgtttctgtaaagctcgtagacaatgctttcgctagaagtcaccaagaggacgtagattacaactacaatacgactttgacgacgctgcagcccgttaatctggcaaacttgccttctgtgtatcctagagcgcccgttccggggcctgcagagttgaacgtgcctgtcgtgacgtctcaggagtgctccgtgattcagtcttcccagggcggaagccccaagccaatcccagctcggcctaacgtaggaagaaagggcagtcgttttcgccacaactggttggggtcgtatatctggttgcagtacgacgaggcacaaaacgtcatgtattgtaagtactgcagaaagtggagccacgacatgccggatatacgtacttctttcgctgtcggcagttcaaatttcaggttggaaatcgttaatcaccacgaaaagtgcaaggcgcaccgcatgtgcatggctagggagtttcattcggagactagtccgagtgcacagagtatcgagatgaaaatccaacaggatcatggt

SEQ ID NO: 1059 - DNA, 456 bp, Leptinotarsa decemlineata
gcagcatcaaccgaatccttcgaaatagggcagctgaaagggcggcagcggaatttgcccgggcagctggctatggtctatatcaccaccacccctatgctgctgctggattcccttggcattcacccctatggcccaatggacctttgcacggtcttcaacctcccggagctggcaacccaacagttatggccgcctccccagtatcatccggttctccccaccccgaccacgggctcatgagctcaccccccggtctggacaaggacgattccagtctagacagctcagaacagccaaagttcagaagaaataggacaacattcagtcctgatcagcttgaagaattggaaaaggagttcgagaaaagtcactatccctgcgtttccactagagagaggcttgcttccaaaacgtcactttcggaagcgagggttcaggtttggttttccaaca

SEQ ID NO: 1060 - DNA, 284 bp, Leptinotarsa decemlineata
ggttttccaacagacgggcgaaatggaggcggcaccaacgcatgaacctactgaagcggtcatctccgggcccgcagggcagcggccagtcttcgatgttcggcggccgcttgaccccctcgccacactacaagggcggctccacccctggctcgccgcttactacgcatctcacctcccaccccgcggcttcgtcccttttgttggggatgggcggcgaaaatagcgccttcaaggctctggtgcctggagggctgatgaattcccaggagagtctcaggcgg

SEQ ID NO: 1061 - DNA, 615 bp, Leptinotarsa decemlineata
atgtcaatcctagcctacaacggtggagccatggtggcaatgaaaggcgaaaactgcgtctcgatagcagcagatcgcagattcggcatccaagcgcaaacagtggcaacaaacttcgaaaaaatattcgaaatgggccctcacttgtacgtcggtctccccggtctggcaaccgatactcaaaccgtcatggagaagctgcgatttagaaaaaacctgtacgaactcaaagaaaacaggatcatatcccctaaagtgtgtagcgcaatgctctcaaacatgctgtacgagaaaaggttcggacccttcttcgtggagcccgtcgtggccgggttgatgccaaagacgtacgagccattcatttgcaacatggatctcatcgggtgcatcaaccctcctaacgatttcgtcgtggggggcaccgcttctgcgcagctgtatggtatgtgcgaggcgctctgggagcccaatcttagtccggaagacttgtttgagacgacctctcaggcactgatcaacgctttcgatagggacgctatttctggatggggtgctacagtgtatataatagagaaagacaaggtcaccattaagaatttgaagactcgtatggat

SEQ ID NO: 1062 - DNA, 928 bp, Leptinotarsa decemlineata
ctggaattggacgatacaaaaaaggtttctggaatatttaggcatgttacttataggagaaaaacaaatggaacacaagttttgagaggattacattgtcaggcttgcaatccatcaaaaaatagaaacacgggacaatcttgccctaaacttgactcaggaggatttaatagttctaccattccacgaaaaggaagtgattcaagtacgaacaacaaaggaagtacacgcagcctccatggttggactaaatccctaacgagacactcgtctaaatcatcgggacataagagaacaatttccaacgcttctacaacctcttgtgagttgggggaggaggcttccaaggtgctcattgctccaggtgtctcctcccctgctatcacatgttcacaacctacacctatacctaaaaataatgctgaatccccacttccaccaatcaaaggtagcgtctccacacctgaaaaacaagcttcctttgaaacaattgataatattgaatttatcgatcagtctacacccacagatataagcactgtggcaaaaaagggctatcatactattgatacagatctagagcaaaaaaacaattcaaaagttgcttcttgtactgaggacgatgtttttaggacatcagctaacaaaccttcaaaagtcaagatacgacctaaaaccaatggcaacaaaaagaagactaagaaagataaggtaaagccgattgttaatatagaattaagtcccgaaaggtcagaatcagcagtgggaaaaatggataaaaacaaaccttcaagagaaaagacaccacctaatgaaactattactaaaatacgaactgtaacaaccgacacagaaactacaaaaattgtaacaacaactacaagtttgaatagatacactttcatgaaaattatggatgatgataatg

SEQ ID NO: 1063 - DNA, 864 bp, Leptinotarsa decemlineata
ttatggatgatgataatgctttgaagcctgacaaaaagttcagaacgcatagctgcagcagtattccttatgataatattatagaaaatctagcaccctttagaaaaagattttgtaatgttcagttatttccagataatgatgaagagagggataatgagaacgatgaagaaaatgataggaaagtttatgatgaagaagataaaaaacgtcatgaagaaaaaattactggaaatgatgtcgaagacaagttgatgcgagaagaaataacacctgttgtggaatcaattcttgaaacaattttcgaaatggctgttgccctaatagagaagaatcaactgcaatttgaaaaagtaaacaaaaaatcaagtgttcaactggaattgggtcgtcgagcatccgaatacaaaagtcgaatgagatgtaatacaggtgatactctaacctcactttatatacctaaaataatccaaccatctataacggacaatctcattgatgcaagaaactttgtggaagaatatgaagagtaccacgaatcttgttcagagatgcatgattcagagattgccattggtcatgttatcaatgaattgggagcaagtgtagatcgaataatagttgaaaagcaaagaaataaacggagggataaatcggttaaacatggaggtgtcactagcttgataccaatagaaactgactctaatgcagaggatgactcggaagttgttcagaatgacaaaagactgttggaagttggggcaatgtataatatccccaaaaatctgttccaaagtactgaaatgactgagattactgaacagactatagatgaactacacaggaatgatgaaaatgcagaaa

SEQ ID NO: 1064 - DNA, 528 bp, Leptinotarsa decemlineata
atgatgaaaatgcagaaaacaatcctgatttggttgaacaaccagttgttgtaaatttgaatttgacaaaagaaggaaaggtggaagacgaggatgatgtctataggccaatagctgttagtccagatggaaggtttttcaagtatgaagaagagattggacgaggttcattcaagaccgtatatagaggcctggacactcaaacaggagtcgctgtagcttggtgtgaattgcaagaaaaaaaactcaacaaagcagagcgccaacgatttagggaggaagctgaaatgttgaagaaattgcaacatccaaatatcgtaagattttataattattgggaatctcctggagtcaaaaaaaagaatattgtactggttacagaattgatgttgagtggcactttgaaaacatatttgcgacgatttaaaaaaataaaccccaaggtgttgaaatcatggtgtagacaaattttgaaaggtctggcttttctgcattctagatctccttctatcatacacagggacttga

SEQ ID NO: 1065 - DNA, 689 bp, Leptinotarsa decemlineata
tcatacacagggacttgaagtgtgataacattttcataactggaactacagggtctgttaaaattggcgatttgggattagccaccctgaaaaacagaagttttgctaagtcggttattggtacaccagaatttatggctcccgaaatgtacgaagaacattatgacgaaagtgtagatgtttatgcctttggtatgtgtatgttggaaatggcaacaagtgaatatccttattcagaatgtacaggtcctgctcaaatttacaagaaagttatatcgggcgttaaaccagccagttatgagaaagtgcagaatccagaagtaaaagatgttatcgaaaattgtattcggcctagaaaggaagacagacctaaagtcaaagatctgctgagtcatgctttctttgaagaagatgttggactcaaagttgaagtagtatcgcaggaaaacaaaaaaattgtttttcgtttacgtgttattgatcctaaaaaaagaacacacaagcataaggagaatgaggcaatacagtttgaatttgatatggaaactgatagatataatacaatatcagaagaaatggcaaaatctggtattatctttgaagatgatgctaaaactgtagctcaattattgaaaacacagattacacagataaacaaagagcgtgagaagaaaaataaagaggaagaa

SEQ ID NO: 1066 - DNA, 347 bp, Leptinotarsa decemlineata
aaaaataaagaggaagaagctttggctcagcagctgcattatcaacagtatttacaacagcaggttgaacaacagatgtcccaacagcaacaacagcaaacgcagactacaacaatacctcagcaacaaagtcagcaacagacacagcaaaatgtggcttcttaccaacagactcagcaagtcagtcaacagcaacaatattcccagcagcagaattatcaggggcaacaagttattcattcagaacagcaaattcaattccaacaatgtgtgggtcaggatcaacaatttcaacagcagcacaatctagagcaacaacaagatcatgttatgcaaaatcagtatat

SEQ ID NO: 1067 - DNA, 1038 bp, Leptinotarsa decemlineata
gcagcagcaacatcaaccacagttgaatcaggagtcagctcctgttcttcaaaggcaagcttctgttgaacctgttcaacagcagaccattattctgaatcagcctgcacccactcatttcattcagcagaattatttaggtgatggccatcctcaacaagctgaatatttgcaattgcaacaacaagaaagtcaacataaaatttctagtatatctcaacctgaattgcttcatgctactcctcctgttcatgaacatagattaagtgttgatggtcagatggattcaggacagaaaggcatggttcctgaacagaaagggctaggaaactttcaacaatctacttttcagcaacagcaacccacctatgctcaagttgctcaacatcaaccacaaaactatcaacaccaaacacaaagttatcagcaaccacatccacaacatgcaggatttcaagcttctcatcagaatctttcaaactatcaatctcaacagagctatcaatcccaggatagtcagacttatcagcaaccaaattaccaacagcagcaaagttaccagcctagtcaacagcaagaacccattattcatatgctttccacaatgtctcatcagccacaagatatgaatccaccttatggaactcagcaacaaagctatccccaaccaagtgcccaaccagctccccagtcttatcagcaaccatcacagcagtccttccagcaacctgttcaacagcagccctatgtgcaagcagctcagccagcaccatatcagacccagcagagttatcaacaaactaatcagcaacaaactgtttattctcccccgcagaacgctcagcaacagaattactctcagcaacaaagtaatcaaccatctgctaattataaccccccacaacaaagtcaagtggcatatgcacctcaacctggacaacaacaaatgaactaccaacaacaaattagtagccaacttcaatccaatttacttccccagcagcaacacaattatcaaggacagcagcaatatcaaca

SEQ ID NO: 1068 - DNA, 2736 bp, Leptinotarsa decemlineata
tatatacagaaatcaaatatagatcctaatcaccaatattctcagtcaaatgttgattgcagtcagcagtatgttcagcaaagtgttgatcctcctcaacaatacattcagccacaacctatagaccaatctcaaaactatatacatccacagctggtagaaccagttcaacaaatatatcaacagataactcctcatcaaacacagactattcaagcaacaggatatacagaacaagttttacagcaatctcagcagcaagttaatcaacctgaaacagacattgaaccagtgggtaatcgattgtctaatatcgaaataccaccaatgaatttagccgagttacagcagaaacttgctcaacagcatttacaaccagcaaaagaccaacacagagcttcaactacttcattacccccagcaacgaatttcgatgtccaacagattgatcataggagattgtcaactgtatcccaaccagcttcgtcccatgattatatacagtgcactattcagcaaattgctgagcagcaaaatcaagagtatcaggctcagaaacacgttggtcaggtaacaatgccacaacatgaatctcttcctctaactgccgaaaatcttgatttaattccatctcaagtacctttggagtctattttatcttcccaatgtgtgacctctaatgtaggtcaggaagctgtacctctagatgacatttcaacatcagaacaagtaagtttggaaatatcatcatcctcgtcgaccgacgagaaaccgagaagaaaaagaggttctctcaagtatcaattaatagtagataaagttcatcccgatggtatagtagagtgccaactactttgcaaacagaaacagattagttttaagtttaacaggtcaggcacaaagccatcggatattatagatggaatgatcaagcaagagtgtctagatgaacctcataagcaattgagagatcatctacaagaagtgatagataaattgaatgtaaatcctgataggattccggaaagtgcaagagctaagccttgggcttatgttcaaaagagagatgactctagtggccaaacattcatcaaatccaactacatagacccatctccaattcaagatgaatttcaaggaatcaaaacaacacttgcagaaaacatttaccagaatttacatcgccgagaaagtctgaattctagcggtactgtttcacgcaaaacaagcaccgcctcagaatacacccctgaacatacacttatagtgaatagatctgctggccattctgagcacacgattgtcagttacgcaactgaaagttctatatcatcaccaggagatcctcaacctgttcccgagaactctgtagaggttccagaaagtcctcaaaaaaaatcacttcaggataattctgattgcatagatgcaatgaaaactgagtttaattatagtttattgcagaaagatgtaggtaaactatttcctggtcagaaagttaacttgaaggtttttgtaatgtctgttgatcagaaagatgaagttattgataatgaacctgcttcaaaaactgaagagcctaatgagacagtaataaaagtaaaacttgaagatggagtcaataatgacagtattaagaccaataatagtgaacctttgaccgacaaatcatcagaaactgctttgaaagttccacaaaggaaaatatcaaggtttttagtgagtccagtattgtcagggcaattggacatgcctaaagacaaagatttcaatgttgaaggttatcaacagcaactgtcgtcattagagaatctgactgattcaggtcctactgaaaattctgttgaaaataaaacagtgctatccactattattaatgatgcagtttcgtcagagcttccaagaaagatatcagcccctcttgaagccacgagacatactttagaattagaaaatagaactgtagagcaaaaagttagtgtgtcttcgatgaaagaggagagtactaaagaagaacctgctcaagtttgcggacctgaactcatcaacacattagaacagcttaaaatcagtttggataatttgaaacacagcagtcatcctaagaaagattctggtgaaatggattcaaaaaaagtaacatccacaagcgatttgacaacagcaaagggagcatctacagtgccacctcaacagccagtagcccagcagccaggatctcaattcatagctccatcaacaatttcaagtgttactcagcaggcgacctcagttcagcagattattcaacctactcagcagacagtaccccagcaaacagtaccccagcaaactgtatctcagtctcactcgactttaccacagtctcaacctgttttaccacaatcccagtcttctatacctcaaccaaaattattaccacaatctatgcctcagactcagaatacttttccgcaatctcagcctgttttatctcaaatacaaccttctttacttcagcaacaacctattatgcctcagtcccaacctgtcattccccagtcccagcctgttatgcctcagtcacagcctgttatgcctcagtctcaaccagttatgcctcagtcgcagcctgttatgaatcagtcgcagcctgttatgaatcagtcgcagcctgttatgaatcagtcgcagcctgttatgaatcagtcgcagcctgttatgaatcagtcgcagcctgtcagtcgcagcctgtta

SEQ ID NO: 1069 - DNA, 679 bp, Leptinotarsa decemlineata
tgaaatgtattctttgtggtgcgaatgtttgtaccgattgtctttggccaaccactttcgcgatactgtcttttggcttccacataatatggatttcagggggagagtttacccaattccaccacatctgaaccatctgggctctgacttggccaggtccctcctaatttttgccgaagcgaggccactcggtccagacggtcttgattggttgaaaattcatctcgtcaatttgacggggttgaagaaaagggaacctatccgtgaaaggcatgtgatccacgcaaatgactttttgtcttgcataagcttcatactattgaactacgccaacaagaacatcgattcgatcctcgagtcggccgacaatccgttatctggatcacgttggtggcttaattcggatgatccatggcaaacgctggcctgttgcatggaaatcgccgatgcggttcgttctccggatccggaaaaatacatgacccacttcgccatccatcaggacggcagctgcaacggtcttcaacattacgccgctttgggcagagacacggccggcgctcacagcgtcaatctgacgcgttcggacactcctcaagacgtttacagcacggtggtgaacttggtcgaggaacagagggctgaagatgcagaggatggacacgagcattcgactcgg

SEQ ID NO: 1070 - DNA, 571 bp, Leptinotarsa decemlineata
ttggaattatggccaacaaagtatgttctctcaaatatggacatgcttgatctggaaaatgatcttccggacgagctcatgtcttcatctccttggggactttccgataacatgggcaatactaagccccctgctcaaggtccaggtccaggaagtttgcagaacggcatcgaaaactctgacagtaacaacctgagacagcaaatgcaacttagtcacctgttgcagcagagtaataaaggtttagcaggcaatgcattagtgttgactagtggtcctttaggtagtaagagtcctaatcttcagtctcctcctaatgtatctgttgcaaaaactggcgtagtagaaatgaatttggggagtttaccttcaagtctgtctaacaatacagggcttcagtccatggccaataattgcagttctgctcaagttatgagttccattcaaggctccattcagggtatcagcaacagtggaggaaatatgattatgaccagtagcaacataaattcaatgggaaacatggcaggaggggggctaatagtgagcagtagtataaacaaacctttgt

SEQ ID NO: 1071 - DNA, 1770 bp, Leptinotarsa decemlineata
gtataaacaaacctttgtcaaatacacctaacatgttttcacctggtcatcctcaacatcccggcaatcataacgtccaggggttaccaaatggaccaatgttgaacagagtaggcatgcacatgaaccagcacgctcctggttcccttcacataggacctcggttatgcggaacaaagtgtaatacaccaaatatgcccggaaatcctccatatgcaacttatcccaactccggtgcccaaggagtgcctgtaggtgtagtcactccccagcaaaaactgaatatgcagaaccagggtccaaggtttggagggccacaaactacttctgttgtaggaccaggttgtggtggcgatggtggtattgtgcagacacaacctccagctccttcaccagcacaaccacagtcgggtgctcccagcggaactcagtcaacacctcagcaagcaacgcagaatccggggagtcaacctggtgcagccccaccaccatctactgcagaccctgaaaagagaaagcttatacagcagcaactagttcttctgctgcatgctcacaagtgtcaaagaagagaatcacaggccaatggtgaggtgtggtcttgtactctgccgcattgtaagacgatgaaaaatgttttgaatcacatgacaacatgcaatgctggaaaaggttgttctgtggcacattgtagctcgtcccgtcagataataagccattggaagaactgtataagaacggattgtcctgtttgtcttcctctcaaacaggcagataagaatcgcaataatcctaatgcggctacaaaccctcctcaaaacaaccaatctcctaacccgtcagcaactgatatgcgaagagcgtatgatgctcttggaatccaatgcccaacaacaggtgcaggtccacctcctgctggtctgattccaaaccctgttccgtcaaggccagctttaaggttacctctgaatcctggacaaaatatacctagtttaggtaatatgagatgtttagctccacccggcccagctgctcccaatgtatctctacctttgaataatgatccctcttccaactcggctcaaattcaaggtgttgatcagactgctgccagcttacgacaaagcgtaaatagtgtgatgtttggtcttgctagtggtgcagaggcagtcaatcaaggtttggtaggccagttgccaggaggtttgcaaccgggtcaagtgactgcatctcctgtagctggaactaaggagtggcatcagtctgttactccagatctcagaaaccatttggtgcataagttggtgcaggctatatttcctacgcccgatccccaggctctgctcgataaaagaatgcacaatttggttgcctatgcaaggaaggtagaaggagatatgtacgaaatggccaattcgaggtctgagtactaccacctactggcagaaaaaatctacaagattcagaaagagttggaagaaaaaagacagaagagaaaagaactgcaattacaacagcagcatacacagcctatcagaccaaatcttcaaggaatgggaccgagacctccagtaccaggtaatattcttccggggcaacagcagtcccctgcccagacccaaccaggtttgagaagcagttccccatctctcggcggtcctcctctaggaggtcttggtgttatcaatcaacctggaaaccgattactattctctactcaacagcccactcaacaaaccgcacagcagcctcagcaaaatgttggtttac

SEQ ID NO: 1072 - DNA, 935 bp, Leptinotarsa decemlineata
ccctctttctcaaggtagtaccaccacttcttccagcaaccagtttcctacaacaagcaatggacctgtcagccttcctcaagtgtcgcctagtggacagaactctcaagcaaatcattatggagatatgttgaagtccagtcggatatctccttcaccatcgagttttgttcaacaatcgcaaaacttgcaaccggtttctgctcagaatggcaatagaatacctaccaccagttcagattcggtactcactccacatgctacaactgcaggtcccaggtcagtcagttcttccaggggggcttctccagcaccagcaactccgattcaggcctcaccgtcatcagttgccgccagtatgggaaagggcatgagtagtgcagagcgtgctgccttaaatgctccaaggcagtcatctctgtcatcccaaatggcagcgataactgcagcagctgatagagatgaagaatccccatcacctcctcggggaggtagtaaaggaaagttggagcaagtcaaaatggaagttggggcagaagagggagagatgaatgaatcacagatggagagtgtgggcggcaaaggaacgagaagtgagattaaaatggagattaagcaggagattgcatcagaatcgatcggggaacatggcaatatgataaaggaagaacctggcttggtgaaagaagaaccgggcatctctgaaatctctgcagatgtgaaaccctccgttgattcaaccagtgttgtagcaacaagcgaaaggaagaacaagaaattcaaaccggatgaactcagacagaagctgatgccaaccttggagaaactattcagacaagacccagaaagtattccattcaggcaacctgtagatccgcagactttaggtatcccagactattttgaaattgttaaaaggcctatggatttgtcaa

SEQ ID NO: 1073 - DNA, 1222 bp, Leptinotarsa decemlineata
ggcctatggatttgtcaacaatcaaaagaaaactcgatattggacagtatgcagacccctgggagtatgtggacgacgtgtggctaatgttcgataatgcatggttgtacaatagaaaaacaagtcgagtatataggtattgcacaaagctgtctgaggttttcgaacaagaaatcgatcctgttatgcagtctatgggttattgttgtggtaggaagtatactttcaatcctcaggtgctgtgctgctacggtaaacaactatgcacaattcccagagatgccaagtattacagttatcagaatagtatgaaagcatatggattaggatctgataggtacactttctgtcagaaatgttttaatgacatccaaggagatacagtaacgctaggagaggatcctacacaagcccaaacaaatataaagaaggatcagttcaaggaaatgaaaaacgatcatctggagatggaaacgtttgtgcattgcaatgactgtgggcgaaaactccaccaaatatgtgttcttcatattgaagccatttggcccctaggttttatttgtgatgagtgcctcgaaatcaaaggactgaaacgtcgggagaacaaattcaacgcgaaacggttgcaggttacgaacttaggcatttacattgaaaacagggtgaatcttttcctcaggaagaaagaagctggagcgggtgatgtatcgattcgtgttgtatcaagttcggaaaaagttgttgaggttaaaccggggatgcgttccaagtttgttgaaaccggtgaacttacaggagagtttccatatcgggcgaaggccctttttgcctttgaggaaatcgacggtgtggacgtttgtttttttgggatgcacgttcaggaatacggttcggagtgtcctatgccaaacacgcggcgagtgtatatagcgtacttagattctgttcactttttcaaacccagacaatttaggactgctgtgtatcatgagattttattaggttatatggactatgtgaaacagttaggttatactatggctcatatatgggcttgtcccccttcggaaggtgatgattatatctttcattgccatccgctggaccaaaaaataccaaaacccaagagactgcaagactggtataaaaagatgttagacaaaggaataattgaaaggatagttttagattataaggatattctgaaacaagcaatggaaga

SEQ ID NO: 1074 - DNA, 1352 bp, Leptinotarsa decemlineata
aacaagcaatggaagataatcttagatcggctgccgatctcccatattttgagggagatttttggccaaacgttttggaagaaaaactgttctccaatttacgagttgcttctttttctttcatgatattttcatccctggaagaaaatgaggtgggtcctgatggaaagaaaaaaggacagaaaaaggctaaaaagaacacaaaatcgaaggcaaatcaaagaaaaaatagtaagaaatcaaatgctcctcaaaatggtaatgatttgtctgcaaaaatatttgccacaatggaaaagcataaagaagtattcttcgttattagattacattctgttcaatcagctgccagcttgaagccaattcaagaccctgatccttttatcaactgtgatctcatggacggacgggacgcgtttttaacgcttgcccgggaaaaacattacgagttttcatctttaagacgagcaaaatacagcacaatgtccatgctgtatgaattacataaccaaggacaagataaatttgtatatacttgcaacaactgtaaagcacatgtggaaactagatatcattgtacattttgtgaagattttgacttgtgcattcattgttatgagaaagatggccatcctcataagatggtgaaacttgggttagacatagacgatggcagttcgccaacagacagcaaagccaatcctggcgaagcaagaaaattgtctattcagcggtgtattcagtcattggtgcacgcttgtcaatgccgagatgcaaactgccgtttgccaagctgtcagaagatgaaacgtgtggtaacgcatacgaaggtgtgcaaaagaaaaacgaacggaggttgccctatttgtaaacaacttattgcactgtgttgttatcacgctaaacactgccaagaaaccaaatgccccgtcccattctgttcgaatataaaacacaagctcaaacaacaacagttacaacagagattgcaacaagcacaattgctcagaaggaggatggcagtaatgtccaagacaaactcgacaaatgctcttccttgtgctaccaatgtgccaatgagtggaggcgtggtgcagtcagtactgccaggttcggttagtcctgctagcactatgaatactggtttacccaatccatcaatgggtattcaagctccacatcaagcaggtattggttcgaagccaggtacacataccccaccagcgaatgtacttcaagtcgtcaaacaagtgcaagaggaagctgctaggcaacaagctccacatgtcggttatggcaaagtcactcctaatcaggttcctggacaaagtatgcctcctccacaaataaga

SEQ ID NO: 1075 - DNA, 581 bp, Leptinotarsa decemlineata
cctcctccacaaataagaaacatgggccatttgggagcaggacaaggtggaaatctcttgccaatggaacagtggcagccaaggtacgctggcggtggtgttgcgcctggtatccgacaatctgtgccacaagtactgcaaccaggtcagatgggtcaaccacccttgcaagccaatccggcaggtgtaaggccaggtgcagcacccccacctatgatgcaaaagcaagccctccaacagctcatgcaaacattgcgctcgcctcagtctccagaacagcaacaacaaatactttcgatacttaagtctaatcctcagcttatggcagcattcatcaagcagagacaggcacagcagattcagcaggcaggtggtggcgcacctccccaacaacagttacagcacattctcaacacgcaaccgaatgctaatcaacagcaccaaactagaatgcaaattcaaagtggaattatgaatcaaccaggccaaggcttaaaccaaggacctggccagccaatgagtcagcctcagtggtacaaacatcaacagatgctagcgatccaaaggcagcaacagcagca

SEQ ID NO: 1076 - DNA, 492 bp, Leptinotarsa decemlineata
cagcagcagcagggtttccaacagcccggtgcttgcccaacgtatcaacagcgattgccaggtatccggcagccacacctaggatataacaattcctttactgatcaacagtatcctcaaatgcaaggactgaaaccatcgccatcgtcagttacatcaccgcaaggggtgatgggtcctcctcaagttcaggggatttctgtgcagcaacagcaactgatgcagagtgtacggagtccgcctcctattagaagtccgcaacctagtccatcatcaagagccgccccaagtcctcgaaaccaggcagttccgagccctcgggggcctcaaccttcgcctcatgatctcgcaacatcagaaatgcttttgagtcaaaaccattcgaatgcgctgcatccacactcatcgcctgcaggagtttcgaatcaagacaacaacgaagtgcctaccatgactcctcaagaccagctgagcaagttcgtggagcaactt

SEQ ID NO: 1077 - DNA, 760 bp, Leptinotarsa decemlineata
ctggagcaaatgtggggtttcagtgtggaggcggaattagtcgaaaatgctgaccgacaggacgaactttgctgttacgttagtcgggtggaggacaaaagtgtggcgatgcaaaacggtatcatcaaaagtgacgaaatcatggtcatcaacggtgccatcgtgtcagatcttgacatgatgtatctggaaagcgtccttcaggaagaacttgcactgtgtatgatgatgcgatcttcaagagtggaacctccggacctcgctggtatactgagagcgacggacgacatcatcgacagccttgtttgtccaccgccaccgtctgagccacccgtcatcagcgaagaaatgatctcaggactcatcgtacctgccccaggttggagtaaagatcgatattccacagactccgaaaatccaccatcatcaatgaccgactcgggtatcagagtcagttccagaaccaactcattcgaaatagagaatttgctcaaaacggccgaacaggtaactggcttctgccgatctccaatagaaacaaggaaagccatcagcccgactggtagtgtcgtcagtaacacatctcaagctgccttaacaccttccagacagttgtcggattcagaaaagctgcggaaggttattttagaactcgtggataccgaaagggcttatgtaaaaaatctgaacaacttgttggaaaactatttagagcctctcaagagagaaacgttcctttcgaatgccgagatcaacgctc

SEQ ID NO: 1078 - DNA, 434 bp, Leptinotarsa decemlineata
atgccgagatcaacgctctcttcggtaacatacaagaaattgtgacattccaaagacagtttctacagaatctggaggaagctttggaattagaaccggatttccataaatttgaatatagtagccagttcaggaacgtcttattctccatcggaagcgcatttttatattatgtaaatcacttcaaactatacagttcgttttgcgcaagtcacagcaaagctcaaaaagtcctgcatccaaacgaaggcaaccaggcgcttcaagagttcttggcggcgagaaatcccaaacaacaacattcttctaccctagaatcttatctcatcaaacccattcaaaggatattgaagtacccgttgttgttgcagcagctgagaaatttgactgattctagcagtgacgagcatcaacatttagtagtcactgatcat

SEQ ID NO: 1079 - DNA, 1260 bp, Leptinotarsa decemlineata
atgagtaacaacaatctgataattcgaaatagtttcgatgaaaacctgacacctataaaaatagaatatattaatccaatggatagcggaagagtggtttctcaaacatttcggcatcctccaggtcaacctccatctaaagtacgcaaaattagttgtaatatcacaacgagttttccgaaaatcgctattaaaaaagaagacggcattaaatgtcactctggtggagaggttcttctcgtcaatggatgttgggacacgtcgaataaaattcccaatattgtagcagaaatgcataacttcaatacagaagatttcagtaaccttcgaaacggtgacgtagttcaagaatcttctagagatctcaccagtccaagtccaagaagttctgacagcggaatcgaatcggattgcacggatggaagtctttcttggctcctaaattataaaatccatgagttacctccagttccagatgccacgagctcagaaaatactggtaccccaagaggacagttccaatcgcatttaattcaggtgccaagagtcagtgataactttgctcagcctaacgacgccaaaaacaatcagaatggacattcctacagatattctggtccgaagaaaccaccttttacttatacagaactcatagaatacgcattgagcgagaaaggggagcttactgtgtccggaatatatcaatggatttcggatcattttcctttttataagcaaaacgacgataggtggaagaactcagtgaggcataacttgtccataaaccctcattttcgaaaaggtggtaaagcagttcaaggtgctggacatctctggactattgctcaaagggatgacaagaaatcctggcaaattcgccaaagaatgactcagtttattcaaaatacatacaaagacgctaaagcccaggaacaagaagctttcgataaggaattgcaagctgcaactgaaagtattttaggagaaataaaccatcatacaaagagtgatggaatgactttaaagagggagtctaatagcatagaagtacagtacatcaatgtagaagatacaacaaatagtttaggagatttcctggcacctccagtttccaaacaagaaatagtgaacgaatgcggcctgggtagtgacttcttcataacggacatcaatccgaacgtgttgggcctgaatttagtggaatctgaggcgatttcagacgcttacgacgacgtgttcgaatattacggtgtcaaggaa

SEQ ID NO: 1080 - DNA, 661 bp, Leptinotarsa decemlineata
atgtcatctgtcaaagtagctgtaagagtcagaccattcaataatagagaaatcaatagagaatgcaaatgtattattcaaatgagtggcaatacgacagttgataaagactatatggagattggacaaagattcaaattgaaatccatcaccaatccaaaggcagaaccaaacacgaaagatgctcaaaaaagttttaatttcgattattcgtactggtcacatgacgagagtgatccgaagttttcttcgcaaatagtagtgtacagagacataggcgaggaaatgctgcaacactccttcgacgggtacaacgtctgcatcttcgcttacggccaaactggtgcaggaaaatcctacacgatgatggggaagcaggaagacggtcaggaaggcatcataccgcagatatgccaggacctgttcaagaaaattcgaaacaacagctcgtccgacgtgaaatattccgtggaggttagttacatggagatttactgcgagcgggtaagggacctgctgaatccgaagaacaaaggaaatttgagggtgagggagcacccgctgctggggccatacgtcgaagacctcagcaagttggccgtcatgagctaccaagatatccatgatctcatcgacgaaggtaacaaggccaggaccgtgg

SEQ ID NO: 1081 - DNA, 421 bp, Leptinotarsa decemlineata
atggctgaagcagataaattgaacattgatagtataattgcccgtttgttggaagtacgaggagcacgacctggtaaaaatgtacagttaaccgagaacgaaatcagaggattgtgcttgaaatccagagaaatttttcttagccagccgattctactagaattggaagctcccctcaaaatttgcggtgatattcatgggcaatattatgacctccttcgtctttttgaatatggagggttccccccagaatccaattacttatttttgggagattatgtagatcgtggaaaacaatctcttgaaacaatttgcttactactggcatacaaaattaaatacccagaaaacttttttttgttgcgtggtaatcatgagtgcgcttcaattaatcgtatttacggattctatgatgaatgca

SEQ ID NO: 1082 - DNA, 230 bp, Leptinotarsa decemlineata
attctatgatgaatgcaaaaggaggtacaatataaagttgtggaaaacattcactgactgtttcaattgcctacctgttgctgcaatcgtagatgagaaaatattctgctgtcacggaggattaagtcctgacttacagtcaatggaacaaatcagaaggataatgaggccaactgatgtgcctgaccaggggctcttatgtgacttgttgtggtctgatccagacaaag

SEQ ID NO: 1083 - DNA, 365 bp, Leptinotarsa decemlineata
ggtctgatccagacaaagaccaaatgggctggggcgaaaatgacagaggggtcagttttacttttggcgcagaagtcgtagggaaatttctgcacaaacacgactttgatttgatatgtcgagcgcatcaggttgttgaagacgggtacgaatttttcgcaaaacgacaacttgttactctcttcagtgcgccaaactattgtggtgagtttgataatgcaggtgcgatgatgtcagttgacgaaacattgatgtgtagttttcaaatattaaaaccagcagacaaaaggaagtttcagtacaacatgaatgctggtagacctgtaacacctccgaggggtgccacgaataaaaacaaaaagaag

SEQ ID NO: 1084 - DNA, 566 bp, Leptinotarsa decemlineata
ttgactgcgtggagcttttggggttgtctctgttttggtccaatttttggaaaaatgaatatacctaacgaatatgtctcaacggcagaggatatagcagatggggtaattagaaagttgaaacacatactaccaacccttgccaggctatgtctaatttccactttcttcgaagatggtttacgcatgtggttccagtggacagaacagagggagtacatggacatgtcttgggggtgtggcaagttcttagcaactatgtttgtcttaataaacttgatcggacagcttggaggctgtgcgatggtaatagtacgctaccaagtgaatattgcttgcggagtgctatttttcattgttgttttacagaccctggcctactctattttgtgggatcttcaattcctattcaggaacttagctctgattggggccctccttctggtattggctgaaagtagaggcgaggctaagagcctttttgcaggagtaccatctttaggagacaataaaccaaagaactacctgcagctgacaggtcgcatattgctggccttcatgttcat

SEQ ID NO: 1085 - DNA, 300 bp, Leptinotarsa decemlineata
tggccttcatgttcatcacattgatccggttcgagtttagttttctacagattctgttggatcttttgggatcagctctcatggtgctagtgacagtaggatacaaaacaaaattgtcggctttgattctagtcttgctgctctcaactctgaacttttaccataacgcctggtggaatatacccgactacaaaccgttacgtgacttcctcaagtacgactttttccagacgctgtccgttatcggaggcctcctaatgatcgtctacttaggtcccggaggcgtttccatggacgagc

SEQ ID NO: 1086 - DNA, 585 bp, Leptinotarsa decemlineata
caggatggggtcatgcatctgaaaacccaaaactaccagagttattacacaagaataacatatcgttcattgggttaactgcccaatacagcgggaagaaaatcaaaatatcatcagaactttttgcaaaaggttgtgttaatacaccagaggaaggtttagcagcagctcacaaaatcggttttcctgtgatgataaaggcttctgaaggtggtggcggaaaaggaatcagaaaagtagaaaaccctgatgattttccaactgctttcagacaggtacaaacagaaataccgggatctccaatatttgtaatgaaacttgccaaatgtgccagacatttggaagtacaacttttagcagatatgtatggtaatgccatttcattatttggccgtgactgttcaattcagaggagacatcaaaaaatcatcgaagaagctccagcagttatagctgaacccgatatttttgaagatatggaaagggctgctgttaggctggcaaaaatggtgggttatgtttccgcagggactgtggagtatttatatgacccctctgggcattactactttttggaattgaatc

SEQ ID NO: 1087 - DNA, 369 bp, Leptinotarsa decemlineata
actttttggaattgaatccccgtctgcaggtggaacatccttgtactgagatggtttccgatgtgaacctaccagcagcccagcttcagattgctatgggcttgcctcttcattatatcaaagatatcagattgttgtatggagaatccccatggggaatgactgagatagactttgatcagcccagacacaaaccccagccgtggggccatgttatagctgcgagaataacttcagaaaatccagacgaaggtttcaaaccgagttcaggtacagtgcaagaattgaacttcagatcatcaaaaaatgtttgggggtacttctctgttgctgcttctggaggtctacacgaatttgctgattctcagt

SEQ ID NO: 1088 - DNA, 4011 bp, Leptinotarsa decemlineata
atgagatcaacaacaatgccaggtaaacacgatttacgatttacgactggtctgaaaaatgatgagaaatttgatgttctatgcttaggatttcggtggtttatgagtgctttctgttttgtcattaatcccctggcattaggtgacgtcaccaaagtcgatattaaaggggataggaccattatcaatctatcgcctttaaagagtgacggtgtcggtgaatgtgtaaatgataatgacaaactagcagataatattttagctaggttaatagggcccatcaatgttaaaaaatggcatgctctgaaaattgtattgtcctccaaaacaaatgaagaattcgtgacgaaactactggaaatcgctcaggaattcctggataggcaaggaggacaacttgagaatgttcatgcaaagaaacagaaaagtttgaacaaaaagcaaaaactgatctcatcaaaagtcattcacaatggaaaaagtgaacccagcgaaataattgttgaaaatgtactggaagaccaaaactctaataatgaaagcaatgataataacgaaattgatgctgagaaacaagaagttgttttaccaaagccaaagtctgaaagtaacaagccatcaaaaaaggtgacaaaaaaatctgaacattcagatagttccaaatcgaaagtatatcaattaaatgatagaaatatattacctttgaaggatatacacatttctgagaatttaacaagtgagatcaatacgaaaaaaaatactgcgccagaaagtgatcaagctggtagccaactggacaaaataaaaattaagttatgccactattgcaacacccatcatattcaagatcaatgcccaattaattttcctcattatataataaatgatgccttgaacaccacaagttggaaggaaaaattcaaaaccctctacgaaattagcagcaataaagataaaaacgaagttaatggtgaaatagttgccaaagattgtaaatacagctattcaaccctgtctctaccaagcgtggttcatatcaaggaaacaaacactcctcacggattaggagcattcacgaaaagtgacattgaaccgttcacacaatttgggcctttggttggagaaatcgtcaaagaaatggacatcgccgaagacgtgaacatgaagtatatttgggaaataaacgccgactctggacacttatatttccacacagaaagcactgttaaatcaaactggctgagatttgtgagaccagcacctactagagatgagaggaatctgtctgtgatatcaaaagattcaaaactttattttgtttctacgaaattcatcaaatcagaaacggagttgctgtattggcaggactcatgcggagggtgtaatatggatttcagtcatccccattactacagaatacactgttctttattccatgatgtgagatacagtctgacgataaaaaaatatcactgcaaagtttgtggagcagccgtattaggaaaggaaaatattatgaaacatgctgccgagttacacaatggacaaggagcataccaatgccaattttgtaaaaagtttttcatgaggttgaattacttagaaatgcatcgaacatatggttgttctgcaaatccacacagatctcgtcctctatgcgacttttgtggtaaaaagttttgccaaccccagaaactaaaagtacacatcaagcggatgcatagcgatatttctcaagttttgaaggagtttcagtgtaagaattgtttgaaaattttgggatctagagccgcactacaaaggcattcaaaggaagttcatcaaaaacaaactgaaggacagtgttcttgttctagatgtgggaagagatttcaaaataagtcgaatctcaaaatacatatatgtaacagttgtgatgcagctttcactaccaaacaatgcctgcaatttcattacaaaaaagtacacaatttcaccgaagataatatgccaaaaatagagagaagtatcgattatacctttcaagcgtatagtggtgctaaagatgaatctgatcataacaaaaacgaatcatctccaaatcaagcagatagagataccgaatctgacaatggaaacgattgtgcgaagagtgatttgacgagtattaacgggaaggtattgagtaaaggttccaaaaaatggattggcgatgagctctctgccgtaacgaaattaccggacatatattcggtggagcgactcagtaaggaagacttgtcgggcataacgttacaaggagcagaaatgtatgagaaaaacaaactttcaaacatcagcgatttcgggagacacgaagcttcaaacgccagtctactagttgaggcagctctagactcggtgtgccacgaacctaacatagatatcgacgtgagctccactccgaactgtaccgattcccttgtcaataatctgtacaacttgacgcagccggatagtttagccgacgtgaactataatgaaacgtgtattaacgactccagagacataaatttgatgtcgccttctgtcaatgaccgcgtgtcagttacagacgaatttaacgaagaactaagacaagacgataacattagcatgcactaccctaactttcaccagaacgatttcagccctccacatagtcctgacattcacagatcgaatttcgtcaggaactacatcaatagtttgtcgccgcaaaactcgtacgaacaaaaaaataatactcccgttccgagtcctcctaggtatgacttcggacatgcggtcaatccggagcatttatcatccgatgacagcaacggcatgaccgtccagaatctcagcctgaatgattctaaaaatggaattcaattggatctctcattgtacaagtcttacaagcatacaagccaggattacgttaggaaattgaaatttgctacagctagcgacactttggatcaagaccatgtagatgttatgaaccaagatctccctagtagcatttcaaatatggagtccgacaaggaactcgtcgagagagatgaccatccgaaatactcggacgaactatcagctgaaatacgcaacaagttcgaactggatttagacatgcgactgaagggttatgacagtattgacagtgaaatcctgaggcagagaaaccacacttatgaaagcggagaattggatttccggaataagacttatgacttgatagaccaagtcgagaaccgcaacaaaccgtatgatgggatcgaatcggactttcggactgaccgaagtttcgagccgatagtactgaattcgtcagagatgcaagggctggatatgtctgcgaggagttttcacaactaccccaacatcaacagatatcacccgctctatccggacgtagacagagtagatctgcggttgaactatagccctccgcctcctacatatacgcacgcggatattctaagagcggtctccctcgatctcacttctcccggcagacacagcgtcgatctcagtttgaggaaccatcccttgcatcaaatcgccaattctcgcttgctgacagaacatggactccaaccgaatccacacagactcttggatcagagtcggttgttaggcgctgaactgacttcgactagacatttaaatggcgagagaatgatggcggatgccagcagtcgaattctgacagatcacagtacgtcgaggatattaaataatgagcagttgagcacgaaccatctgctaaactcggagcaaaacaggcttttgagtgacgagagtagattgctcggagatggtaggattctcggttcgtccacaagtggaggagtttcgccggtgcaaggattcagtggatattccatttctcaaaatccgtatcatcccactcctataccgacgaggccgcacagcatcacatgcttcatggccctatctgatgccaccactgcactggaggtcacagaaacagaaaatactaaatcaaagaaaaacaagcttctcatt

SEQ ID NO: 1089 - DNA, 779 bp, Leptinotarsa decemlineata
tagaatatgcaatggaagccgttaatctaggttcagcgactgtaggtttgaaaagtaaaactcatgcagtgctcattgctcttaaaagagcctcttcggagctctctgcctatcagaaaaagatcatcaacatcgacgagcatattggaataactatttcaggactcactgcagatgctaggatccttagtcgttatatgaggaatgagtgtttgaattacaaatattctttagatgcccatatgcctctgaatagactcataagcacgttaggtaataaaatgcagcattgtactcagcgctatgaccgtagaccatttggagttggtcttctagttgctggctatgatgagtcaggttctcatatctatcaaacatgtccgtcagccaacttttatgactgcaaagctatgtcaataggcgctaggtcccaaagtgcgagaacttacctcgaaaaacacctagatgaacttccttcctgttccctggagcaacttgtcaaacacggtttacgtgccttaagagataccttgcccccagaggtagacttgactacaaaaaatgttgcgattggttatgttggtaagggacagcctttccaaatattggaagaaaatgaaacggctccatatttggccctgattgagggagaggaaagaagaggtggtggggcaggaggagctggtgttgaggctcagcaagccgatcccctaagagaagatacgggggacgaagggcccagagacccagtgccaacaacagcaatggataccacagaa

SEQ ID NO: 1090 - DNA, 2174 bp, Leptinotarsa decemlineata
acaacgtcaagatgttccaagcgcacaaagaagcacttcgtggcataagcttcagcccttcggacaacaaattcgttacgtgttcggatgacggcaccctgcgcatttgggacttttttcggtatcaagaagagcaagtactcagaggtcatggagctgacgtaaaatgtgttcactggcaccctcagaaagccctcatcatatctggtagcaaagacaaccagcaacctataaaattatgggatcccaaatcgggacaatcattggcgacgctgcacgctcataaatcgactgtgatggatttaaagtggaatgataacggcaattggctaatcacagcttctagagatcatttgctgaaattgttcgacgtcagaaatcttagccaagaagtccaaacatttaggggtcacaaaaaggaagcttcgagtgtagcgtggcaccctattcatgaaggacttttcagcagtggcggttccgatggggccattatgttttggcacgtgggtgctgataaagaagtaggagcaatagaacaagcgcatgacagtatagtttggactctttcgtggcatccgctcggacatattctttgctccggatctaacgatcacactagtaaattctggacaaggaacaggcccggagaccaaatgagggataaatacaatttgaacacactaccatcgggaatcgcaggactggaagatttagaaatgggtaataacgacgaaccgacttcgataattcctggaatgggtcctgaagataaagttgatattacctccattataaccgatgaaaatcaagcaattccaggattggacttggacggtatcggtaatgaagaaaaaccaaagcctaagaaagtgcctttcagcaaacccattccacgtaatttccaagctcaatggaacgagacaaatgatgatcctgcaggagctcttagtgaagtcattacacaaattgtagaaaatactcctggagtagttcctttgcagcaaattgcccctaatgctataataatatacgggaaactgattccagtagaacccggatcaaaactggaacaggcaattgccgacggaccggacgccctccagaaattcatagcttcaggccaaatcgaagagcttcacgacgtgatgccgttaaacgacgaggaagactatctgaacgacgactatgacgatgacaacgataaaagcaacattccaagcaaagacctcaaaaactcgaaaacggatttcgatatgcggcattctgatcaagacatgaggcagttcagcggaagggatagcgacatgcgcaacatgggcgacgttgactttagaaaagctcctatggatatcgacttccgaaataaaccacgtagagactttgatatgcggaactctctgcgtaataaacccctagacgaagatttccgttacaacaagagggacgacaaagaattcaggaataatcagtacgacgaagaagaagattataacgaagacttttatgaagatggaaactggccccgcaacgggaagttcaacaatttccgtcgaggtcggggtaacctttcggcaggcagaggtaaaatgcccttcaaccaggacttcagaggaaatagtttcaaaccgaacagtggcaaaccggacgacaggaaatggggcaaccaaaaagaagatagttgggatcaacaaagcgacagcaaatggaaagacaacagcgatgacaactggaacgataaaatggatggtaactggaacgacgacggaaactggaacgaccaaaacgaaggcaactggaacgatccaagcgaagacagctggaacgaccttggagatgacggttggaatgaccgtaacgaagatgagtggactgaaatgcctccttcttcctccaatgacttccgaggcagaggaagcaaccacagggggcagagagggggcggtccgagagggagcagaggcaaccagcgcggtagagggggaatcgctctgggaagcggaagggttcaaaagataggaagaggcggcggtggtaacagaggctcaaggggaggtcctggcattaggggtccgaggggcggtggccctggtaaaagaggcggcagttggggtcagaggggaaatcgcgggctaggtcgcggtaggggagatcagggagggcgaggacggttttcg

SEQ ID NO: 1091 - DNA, 505 bp, Leptinotarsa decemlineata
atggcagggaataccggaatggagcagcttattccaattgtgaataagctgcaggatgctttcacacaactgggtgttcatatgactttggatttgccacaaatcgctgtagtgggcggacaatccgctggaaaaagttcggttttagagaatttcgttggaagagacttccttcctagaggatctggaattgttactcgaaggccactcattttgcagcttattaatgcaaatactgaatatgcggaatttttacactgcaaaggaaaaaaattcgtggattttgaagaagttcgcaaggaaatcgaggctgaaacagaccgagtcactggaagcaataaggtgccgattggtgatcaaccaattgatattgagcaacaaatcagagcgatgattctccagttcatcaaaagagaatcgtgtctgattctggcagtaactccagctaatacggatttagctaattctgatgcgcttaaattggccaaagaagttgatcctcaag

SEQ ID NO: 1092 - DNA, 419 bp, Leptinotarsa decemlineata
agaagttgatcctcaaggtattcgtacaataggtgttatcacgaaactagatcttatggatgaaggcacagatgcccgtgatattttagaaaataagctcttaccccttcgaagagggtacatcggtgtggttaatcgttcccaaaaagacattgaaggtagaaaagacataaacgctgccttgcaagcggaaagaaaattcttttacagtcatccgtcgtatcgacatatagcggatcgtttaggaacaccctatcttcaaagagtgctcaaccaacaattgacaaatcatattcgagacacgttgcccagcttgagggataaattgcagaaacagtatctgactctagagaaagacgtggatcagttcaaacatttcagacccgacgacccggctattaaaacaaaagctatgctcc

SEQ ID NO: 1093 - DNA, 896 bp, Leptinotarsa decemlineata
aaacaaaagctatgctccagatgatacagcagttgcaagtagattttgatagaacgatagaaggttccggctcagctcaaatcaacacgatggaattatcaggtggtgctaagatcaatcggttgttccacgagcgatttccctttgaaatagtcaaaatggagttcgacgagaaggagttgcggagagaaattgcctttgcaatcaggaatatccacggtatcagagttggattgtttactccagatatggcgttcgaagcaatagttaaaaagcagatatcccgcttgaaagaaccgtcactcaagtgtgtggatttggttatgtcaaggtaccctcgtttaagagaagaagcagaaagaatcataactactcacatcagacaaagagaacagtattgtaaagagcagctctgcttactcatcgactgtgaattagcatatatgaacaccaatcacgaagactttataggatttgcaaatgctcaaaaccagtcggaaagtgccactgccaaaggtactcgtggtacgctcggtaaccaagtcattcgtaagggttacatgtgcattcataacttgagtatgttgaagggttcgagggattactggttcgttctcacttctgagaacatttcgtggtacaaggacgaagaggaacgggagaagaaatacatgttgcctttggatggactcaaattgagagacatcgaacagggctttatgtcgagaaggcatatgttttctattttctttccggatggcagaaacgtgtataaggactacaagcaacttgaattgagctgcgaaactttggacgaggttgactcgtggaaagcttctttcttacgtgctggtgtgtatccagaaaaacaaactgaaactttgaatggggaagat

SEQ ID NO: 1094 - DNA, 849 bp, Leptinotarsa decemlineata
atggaaacggaagatgaccggtattcctattgttcaagaaacaacctgaaaaccacgaatggtagtttgggggagacgggcatactaaccatcattgattatctgaaggacgctatgaaggccatggatttgatgaggagccaccagatgttgactgacgtagtattagaagtgggaaaagacgtgttttacgcccataaagtggtcctggcagcagccagtccgtatttcaaggccatgtttaccggaggactgaaagaatgtgatatgaatagagttaagttacagggggtgtcgccgacggcattagctaggctcatcaatttcatgtataccggcaggataagagttacggaaaataatgtttgccaactattgccagcagctaccatgctccaggtttgcaacgtcatccaggcttgctgcgactttctagagcaccagctggatccgagcaacgcgataggtattgcgacttttgcagaacagcacggttgcatcgacctatgcaagaaggcaaaccagtacattgaacgatatttcagtcagatatgccaagaggaggaattcttacaactgaattcgtatcagttggtaagtttgataatgaaggacgagttgaacgtccaagacgagaaagaggtgtacaatgctgtactcaagtgggtgcgttacgacgaagaatcgcgacaagcaaaaatggagggtattttgtctggggtgcgatgccagtttcttccgcctcgattcctcaacgagcaaatgaagacttgtgacgtcattaagaaagcgccggcctgcaaggagtatttagctaggatttttaaggatttgactttacacataaaa

SEQ ID NO: 1095 - DNA, 984 bp, Leptinotarsa decemlineata
ttgactttacacataaaaaccgtcgttaaagaacgatgtccgaacattccacgtgtcatatacattgccggaggttactacaaacagtccctggacgtactagaaggttacaacgttgacgagaaaatgtggtacactctggaccgactcacgggatatttttatgccgtcggaggaaggaacaacagtcccggcaacagttatgattcggattgggtggataaatataatcctatcaaagaccattggaggccctgtaatccaatgtctgtgccacgaaatagagtgggagtggctgttctagatggacttctgtatgctgtgggtggtagtgaaggatccaggtaccacagcagtgtggaattttatgatccggaactggacctttggactatgataaaaccaatgcacttcaaaaggctcgctgtaggcgtggcggttgtgaacaggctgctgtatgctgtgggaggctatgatggtgtcgatagacttaataccggggagtgttatcatcccgaaaataatgagtggaccatgatagccccaatgaagatagcgaggagtggagcaggagtggcagccatcaaccaattcatttatgtgattgggggttatgatggtaagaagcagttgaattgtgtggagagatacgacacagaaaaggatcgctgggagtttgtgaaatccatgagaatatgtagaagtgctctcagtgtgactgtactggattgtagaatatatgcaatgggaggctatgacggcatgaatttcctgaccgacgtcgaaatatactgtccagtcaccgacacatggatggatggagttccattaacatccggaagatctggtcacgcaagtgcggtttgttaccaggcttcgagctctgaaaaaacctgcgccattctaggccaaccaactcccgattgttcaacatcgagaagaccgcaattcgataactcgatacagaaaaaaaagtttcccgat

SEQ ID NO: 1096 - DNA, 341 bp, Leptinotarsa decemlineata
tcaagtgggtgggcaccattatggggcccaaagataccgcctacgagacgctgaagttcaagttgagtctgcagtttcccaactcgtatccctactcagcgcccacagtcaagttcgtcaccccctgcttccaccccaacatcgacataactggaaacatttgcctcgatatcctcaaagataaatggtcagccctgtatgacgtgaggactatcctgctttccatccaagctctcctgtccgaaccgaatatcgatagccctttgaatgctcaagccgccgaaaaatggcaggttcccgaagaatacaggttattagttttacagacccatagagaggcg

SEQ ID NO: 1097 - DNA, 2152 bp, Leptinotarsa decemlineata
atgtctgacgagtatgatttccgacatgagttgggaaatgtgccttggagattggtcgaacagatgcaaccacaaccattccgaaccttcagatctgaattccacatgagcagtaccagcgaacacacttcaacatatactacaacaacccactacagcaaacagtatgtccaaactacaaaaacctcttccaactctgagaacggcacaaccatcaaaatcacagatgagcagacaaaagataactggaaaaacgatgaagtggaccacataactaacggtcgtccaccagacaaacacaccaccctgactaaaataattcaagaaccccaaagatgggacagctcgatgcaattcacagaaatcaaatcactgaaaaggagccataacactcccgaaggattagatatcctcgacatcgccggaatcatcaatccctatacgggagaattactgacaatacgagaggccatcgccgaaagaatattagacgtcaggaccggtaaagtagttgcctctatggacggcacccaaatttctataggcgaagctcaaagagcgggactagtcgaacctaaaattgcagaaagactgagcagcccctgtggaagcactgaagatggtcgtgatctcacacttctggaggcaattcaacgcgaaatctatgaagcggagcaaggttacctagacccatctgagaagagaatgaaggtaacccattccatcactataaaccaagccatcgatgatggaagagtcgatattcagtccggaacgtacacgctagacaacggagaaacaattgacatcagggaagcttataagcgagggtaccttcttcagcacacggaagtcaagttacaaacaggtgcagtgcccttgtcagacgccattagtcagggcttgattgatgataaaaccgggtggattgtggaccgcaactcgggaaataagtatcaaatcgatgccgcggttaaatgtaacgtcgtcgatggtgacatcagggaaatcgttgatcccaaaacggatagtaaaataacagtaatacaggccctagagagtaatttaatcaacccgaaattaggcaagtacgtattaggccacgagaaattgaatttcctcgaggctaagcgccggcagctgatagtcaaaccaaaatctctgaaagaagtagttgacgataacttgatggacgatgaaggtaagattttctcgccgatgcatcaaacgaaattgactctattagaggctgctaatcgcggcgttctagacctcgactccactaagaccatcttggatctgagaactaacgagcatgtaacgctgagcgaagctctcaaagaaggcataattttgcctgacagcaagttcaggaactgcgtaacggaagaggtcgttaccatccaagaggccgttagcaggggttacataatatccgtagtcaggaagtccatctttgacgtcgacggttttcaaccgcctgataaatcagatcacatcagcttcaatgccgccaacgtaaaaggtttcatcagcaaaaagaatgggggtagtctattggtgagtaaaaagagcggcaagctaattccgtttatagaaggggtaacgtccggggaggtaaaaccggaagtttacgaaaatctaacgcgacctatcggtataatcgaaaaccagcgtgaactgaatcttttagaagcagtatttcgcggctatatcgacccgaaaagcggtaacctcatagacttaaccacaaacaaaatcgtctacctgaatgaagccattgcgcaaaaccttataactcctgaaggcgctgctctcttgaatagcctattgaacctgaacgtgtctacacgcgtcacgcgcaccctagttcagaggtacgtcactgtcacgagcaaagatgtaaaacaggaagttatcacttatacggaagcccttcggttgggtctgataaataacgaagaacagacttataccgatccccaaaccaaaaccgttattcccatcgttcaggcgatcagcgaaggtaagttagcacccgataccgaaagttccgaaaaaatcgtaagccccagtacttcgaaaacgtccactgtttctattcatagtaataaaggttatcccgttgcgagagattctgattcgtccaata

SEQ ID NO: 1098 - DNA, 5397 bp, Leptinotarsa decemlineata
attctgattcgtccaataccaaaattcagtcgtcggaattcataactaatgagaagaaatctttcgaaaaatacgtgtatgatgttcccaaagaaggttggaacctggcagacgccataaatcgagaattgttcgatcccgttagcggtttgtttattatatacggcactgaccgtctggtgacattcgaagaatgtatcacattaaaacttatcaacagctcttccgtagttgtggtagatcccctcaccaaacgtcaaattccagtcacaagagccttagagaaaaaaattgtgaacgctactgggcattacataactgaaacagagcagcttacaatgcaagaagctatcaacagaaacgttatactactaggagggaaagtggagacagatcacacatccaaagcagagtctaaatctcttgaaccagtgcaaattcaaactggtgttatttacgaccccaaatctactttggttatattctcgcaggaaaaccagtcatcagatctcataacagcagtccttgagaacaaaatctcttcagaaactataaaagttaaagacccaaaatcgggaagagatatctctataaaggaagcaattgcacgtaatgtaattcatcctgaggaaaaaacttacaccgataaatctggaaataaaatatctttgcaggacgcgactaagtcaggtctactggccgttgttggaacgcctattttagccacgaaatcgatgattggaatcgtcaagaacatttttgtcgtagatccgaaaacaggtgaacaaataccggctgaggtagccctgcaacaaggtcttatcgatcaggaggcatttgacaatttaagatacgcaaattctacccatgtaactgatcaaggcgttcagtctgtaatcactgaaacccacagttctatacgaattaccgatcctaaaaccgggaaaacatatacatctcatgaagctctagctgaaggaatcatcacacctgagcaactggatgaaatcaaagtccagaaggaagatatccctaaaatgaagaaactgggtacagtctcgatcagtctggacgaaccaagtaaaatgtcggaggcagaaaagaccagagcgcgtattactatcgagcctacgtacagagtgaagattggacgagctcaatctttgagcccagaaagagaagctaaacgagtagttttgcaaaaacttagaaagaaaatagtgaaacctatggaagcgctcgaaacaggtatcatagatgaggatacagcacaaattttggaggagagagaaaggttcatttcctctgaaggtgagcagctgactctacaagaagctctagaagcccgaaaagtggacggccaccagggcaagatcgtggatcctcaacgaggtgacttactcaccatcaaggaagccatcgagcgtggaattttggaccctgatggtaccaatgaactattagtgcctttgaatcgaagtctgtccattcctgaattggtgaaacagggtttacttgatgtagaaactaacaaaattgtgcaccccgaaaccggagctcatttgagtatcagcgaagctattgtctgtgatattatcgatccgctcagcactctagtcgaaaagtctggcgatgtattgactgtgagcgaagcgatcgaaaccggtgtgatagacgacgagaaatcgacagttcaaacaagtcacggcagcttagatatacaggaagccgttaaagacaaaatatttgacaataccgtccactctggacctatagaaatcccacctgcaggcatgacattccctgtagccgtgaaacggggtctagtcgataccgagaaaaaggaaattatgaaccctattactaaggaaaccataccgctcagtgaagctatcgaacataactttataatgtcgttgccgttccccgctagtcctgaatcgattaggatcgaagatgccttggaatctcatctaatcgactccgaaaaagggactttcactgaccctaaatccggaaaaatgtaccccgtatccgaggcggttgaaaaaggattgctggtcataaaggaaccgcttgaagggttgtctttcgcccactcaactcctgttactactctaactgagacgataaacactattcatactgtcactaccaaaacaatcgaacttcaaaccggattcgcccttctgaacaagggcgaagtacagaacttagaaactggtcaaattatttctatagatgaagcaaggaaacagggaatcgtcaaagatgtcagtgaaacaaagaaccgcaccattgtcaaagatatcaagatgagtttttctgacgccttgaataagggcctcgtcgatatgagcgcgggtattttcacagatccgaactcaggagaaaaagtttccattgagcaagcattacaagaagggaaattatcagctgtgccagacactaacgtagaaacacatgaaactgtcgttactagtcacaaaacaaccgaactgaatatcgccgaagcttttcaaactatttacaatgaagaaacaagcactttccacgatccgtctgacaaagataaacagctaacgttcaaagaagccatggagaaagaaatcattgaccccaactctatggtgtatgacgttaccgcacacaaacctataacagtggagcaagctgtagaaaaggggttacttgatccaaagactggcaaagtaatggacgagaagtccgggaaaaccataaacttcaaagaagcgaccaaaaaaggactcatcgcagttctaggcgggttggcactgcctgtggtagctcctgttttagcaggagctgccgccgtaaaagcagttaaagactttgctgagaagaaatcacagcgatcttcggaaacaacacaggatacagcaacaagctctaccactacaactacgacgcatgaaatctactctcaaaaattactcaagcctgtaaaatccaagtccagtgatgtgaaagaagaagttactctaatcgtggaggtgccgcagaagccggtctttcttccaatcggagacgccatctcgcaaagtagaatcgagccgaaaatctgtcgggttgtacaccgtaacgaagaactacccttcacggttcaagacggtttagatcaaaataaaatcagccttcttgacgaagttcaagtcatgagcaatcacgaagttgtcctggtggaagagtacaacaccagcgtgctagttatgtctaaaactataaccgctcagaagctagcggaacttggctactatgacccgaaatgtcgcaaattcctcaaccccaaaactggagcttacattagctttgaagagcttgtctatggcttgcgagtgttcgatcccgagacgattctagtgaaagattcgaccaagaaaccccctgtatacatcacccttgatgaagctttgaggagacctttgatcgacaagaacagcggctacatggtggatcctaagactggtaaaaaggtgccgttcttcgaggccgtgaagcttcgatggatcatccacgtcaacgacaaacccaaggagaagtaccaaccgctgacattacaggaaatcgtcgaaacagatatgttcgatcctgtcaacatcacagtagcaacagagaacaagactctacctctattcaaagcgatcagctgcaatatagttgatggcaagtctgttactatcagagatccaaagagcatgcaattagttccttactacgaggcagtggataaatctatcgtagaccctcagcgggggttggttatcaacacagcaacgcaacatacgatgcagtttcctgaagctttcatcaaaggttacgtgctcgctataccgagaccaatttcacttcaagcagccattcacaaggacatgtacgatccacaaacatgcaaaatcacagaccctctgaccaaggcgcagctctctgtagacgacgctgtggatagactaataatcgacgataagatcagcgaaataaaagatactaaagcaaacagtttcatatctctagaggaagctttgaagcaaaaagtattgaattccgaagaaggtaaggttaaagacaccaaaactggccaactacttccgttaaacaaagctcttgatatgaaactgattcagacgaaaccggtagtgttcagtttgcttcaagctatcatccaaaactactatacgtcgcgaacgggtttgatactgaatccgataactggagacgagataactctacagaaagctatagagtgcaagctaatagatcctgttactacacgaatcaaagacgataaacgaggccgcatcatagaaatcaaagaggcgatccaaagtaacttagtcgatgcagagaaaggggttttaacgaatccgttgcttcctctagaccaagcttacctcagaggttacattctcagcacggtcctgccgtggtctttgcaagaaacattggcgcaaaaggtgtatgacccgaaaaccggtttgttcactatcaacaacgcgaacgtcaccctagtagaggcaatcgacggtggcgtcgtcaaccccaacgttctgacagtcaaagagcctagatcgggcgatataataaccctgaacgacgctataaacttgaaactgatcgatcccgtcaaaggacaggctttggatccaatgaataacaccgaaatgaatctctacgaagcgtacgacagaggtctagtcgtaccgtacaagaaccaaatcaccctcccagaggccgtattcaaaggtttttacgatccaactacgggtaagtttattaaccccaagaacaaagaaaggttgaaggcctccagtgcgattaatcggggctacgtcgacatttcctctactttagtaaccatcgatgaagaaatagtgacgttcgaacaggcagtttacgacggcattatcgacaccaacgaaggtgtaattctaagctacaacgagccagtcgactttaacgaagccttcgaaagaggtttactcgtcgaaatacgaccgccgattcctcttagcgaggctatcgccaagggaatctacgacgaagaatcgcagctattcttagacccgcagaccggacaatatttaactctgatcgaagctatcgaaatcaatctcatagacgccgagtctgttagcgtaaaagacacgcgtataggtaactggagaaagattcctctcatcgacgccatacacaataactacgtagacggaaacaccggcatggtcaaagatttctctaaaggggagtcgcaagaggtgactctacaaaaagctttcgtcctaggcattctagttgacaacaaagctgcgatatctttgcagagagctatccaccgcggtttatacgatgaaaatacaggaaagattctggaccctaaca

SEQ ID NO: 1099 - DNA, 4410 bp, Leptinotarsa decemlineata
agattctggaccctaacacggagaggaaaataacactgcacgaagcgatccgcaacttcattatcaacccgcttctgccctgttacttcgataaaaatcaaggaaagctgcagagtttcgcggacacctgcagactgggaatcatcgataagcgaaacggcactttcaaagaaccacacggagaaaaatctatgaaactctccgaagcgatgaacgcgggcctgatagtagacattgaattcgccaacttcggtttgtacgaagctttggaaatggaactttatactccggaagagggatcgttcatccatcccgctacgggtcgtaagtataacctcaaagacgcatgcgaaaacgagctcatcaacccagtaacgtctctagttaaaaacagccaacagaacaaatacgttcaactgactgttgctgtcgaatccggcctcatagacaaccagcttggcgtgtacgtcttccccaacggcaatactgtggatttgctcgaagccaaaaacaagggcttgatagtgacagctcgcacgcctctgactctggaagaagccatcaaaaacgttctttacagaccggagtcggggaaattcgtcgaccccgtaaacggagagttttacgacctttctcaagccatagctaacggtttcatcgatcctcgggcgacagctttgaaagacaagaccaacaacagcgttaaatccataacagcagccattcaggatcataagatagacgtggagaagggacgggttttggattctaagtcgaagaaaacgtacaacttggacgaagctttcaagaaagggttactgataacgctagagaagcctctggcggaagaattcgtgcagaaatcggtacctgcaaccgcagcaatggctaaacaagctcgcgagtactccttggacgaggccatcaaattcgagttgcttgatccggaagttgccgttgttaaagaccttcaggtaggtaaatttagatcggtcgcgagcgctattgatgacaaacagctagacgtcgcgaaaaccgtcatattcgatccgacaacgggcaaagtaaagtcattagtggtcacgtacgatcaaggtgttataatatacctgaaggaaccatcatctttcattcaggctatcgaaagtggccttctaaatgtcgctacgggaaaattcacagtaccgcaatccaacgaggttttgaccttaaaagagtccatcgcgctgggtttcatcgacccggacactgcactcatcaaagatttcaacaaaaagaaattgatcaaacttcccgaaggcttcaggaagggcctgatagacgctgataaaggcaacgtcctagatagctccacttccaagctgttcactttatcggcagctttagaaaccggtttgctcatcaccaccaacaaaagcttcacactgatggaaaccgttacttacggcgtgtacaatcctactacagggcgtttcaccgacccgtttgtcaccacaaatataatcgacagaaagaaacttacgctagccgatgctatcgctgggaacttgatagatcccagtagtacggtgatcaaagatccagagagcggtattatagagcctttgttgtatgctatcgacaccaatttggtggatgcggtagaagggaagatccacgacaaaaatgaaaataaatacattgatttcgccaaagcccaagagaagggttggatcttgccagcggaacaaaggcaagcagtcgaagaaaaatacaaactgtgcgacgacactttgtcaaaactcctcagctggatagatgaaatagaagaccggatcgcgaaccaagacgtcatccacgaggtggaagaggaacttcgcaatcaaatcaacaccatgaaacagatccgcgatgacctggaacaacactccggccaggtttcctactgcggagaccaacaggagactgaaatttctgctctagaaaagagcggacgtaacctcaaaacgcgttatgacaaagctggtgatcgcactgagaaacttctaagaaggttgctcgctgctagggatgaactggctaagctcaaaggcgagctcagcattttttcgacatggttgagcaaggcgaggagagttctggaagacaaggagaggtctttgagcgatttgcagaatctggattctagtaccgatagtaccaaggagttcgtcggagacgtgatagcccatcaagcggatctgagattcatcactatgtctgcacagaagttcgtcgacgaaggaaaggaatatctcaacatcctcaacgacttccgtaccacccttccctcacgtctgcctcacatagaaccctactcgtcccaagactcgcccgtacgcagcgaagtatctttggtcacccagcaataccgcgatctcctgcatcgtgctaacaacctttctgatcgcctttctggtgtgggtggacgccaaagagagtattcagacgctctagacaaggccaaggcttggctcagagacgcggaaccaagagcgaaacagctgctgaacgacccgatcgccggagatccgaaagcggttgaggatcagctacagagcgccaaggctctgaacaacgagttcgtcgctaatggaaggctggttgacaacgccaaacaggccaccagttctctcctcatatctcttgagggccagatatctccatcggaaatagctcgcctagaggaaccgatcaaaactttggaaaacaaatatacccaactgagcagcgccatcgcgaatcgctgccaggatctcgaaacagccctcgtccaatcgcaaggcgtccaagacgccctagacggcatcatcgactggttaaatcaggccgagaaccagttcaagaacatgcagaaaccggcgtcgctaatcaaagaacgcctggaagaacaactgagagaccatcgcgcattccaagccgacgtagacatccacatatcctccatcgactctatatacttatccgccaacgagctgatagtgtcgactagcaacgcgagagttgccaagaaaatagaaggaaaactaaacgatgtcaaggtgagattcgagaaacttttcgaccgcgctcagaatcgcggggtgtttctggaagaaaccaaccaagacctgagagtgtttggtaatcaagcagtcaagttcggagattggtacaccagcgtaatggatatcatagagtcgaaagacatgagcaagctacccgcagacgagtttgtcaaccagatgaagaaaatcgccgctaatcgggacgaaaaccgacacatgtacgaagagaccgtaaagatcggcaaagaactcctcaacaagagagacgtcaccgatacggccagcgtgagagaccgcgtcaagttgcttgaaacccagtggaaggaactggagcatttactcgaagaaaaagccaggctatcaagtctacgcgcagagcataacaagtcgtacgaaacattgaggacccaagtgaacgagtggctcaacaaaatggaattgaaagtcacgcgactggaaatggtcgctgtgcatctggaaactctaaagaagcaaaacgaagagctcaaaccgattgtcaaggagtataaagaatactcctctaccatcgacaaaatcaacgacatcggcaccatatacgataacttaatgagggccgataggccagagtcgcctaccaggcgaaaggcgtacagcccgactaagcgtacctctccagctcctggaaaattgccatctagaaacggtcggtcaccatcacctacaaaagtactatcaccgctatctccaggaggttctagtggcttctcctcgcgcagatccagccaggacggcttccatctcgaagagttgtcaccggttcaacaacaaatctctgaaataaacaacaggtattctttgctaggcgctaaaatcaacgacaggcagtccgaaatcgactcggtacgcgacgaagtcaagaagcaattggataacctcaggatcctcagcggttttctcgataaagtccaaagacagcttcccaaagacacagtacccagcaccaaagacgaagctgacaaacttaacaaacaaattaaacacgtgttggaagaaatgtacgaaaagcagtcgttgctggattccaccaagatccaaataaaagacctgctcaggcgaaagcctggtgcgattggttcggataatttgaacgacgaacttgaagacgttgtttcgcattggaagagcttaaacgaccacttgaagaaccgcatcaaattcatggaagacatgaaggagttccacgatatccatgattctttgacctcgtggttgggtgctaaggataggatgctaaccgttttaggaccaatttccagtgactctcgcatggtgcagtcacaggtacagcaggtgcaagtgcttc

SEQ ID NO: 1100 - DNA, 2599 bp, Leptinotarsa decemlineata
tgcaagtgcttcgcgaggagttccgcactcaacagcctcagttgcagcatctcatcgacgtcggcgatgacgtcttaggatacctggacctcaaatctcctgatcaccagaggattaactcgaagcttgccgccgttcaacaaaagtgggcggacctactaggcaaattggaggaacgtgcagattcactcggcgcggcagcagacaccagcagagaattcgacgctcaactcacgcgactaagagacgcgttacaaggaatatccgacaacttggatgaactaccattagacaaagaccccgaagaacaactacgtaaagtggagaatctcgaacgacagctggagggacaacgccctctgttaaccgatttggaagctaacggagcacagctctgcgacgtgctgagtgatcctgcttccagagccgatattcaagccaaactggtatcggttggaagacaatacaatgctctgcaaagaaaactggaccacaagaaggccgagattgaaggatctatcagagatgggcgccagttcgaagagtcttgcgccaagacactaggatggttatcggacgagcttggatcattatcagaaaaattcctaatatcagccaacagagatgtactggaacaacaagtcgcgcagcacgaacccatctacagggacgtgctcgctagagaacacgaagtcatcatgcttctgaacaagggcagagatgttctaagtaggaataatagagccgatacgagatctctgcagagagacctggacaagatcaaccagaactgggagaagctgcgcaaagaaactttggagaggcacaccaggttgcaaacctgcaaagagcactgccgcaagtactacaaggctttggaaaccttcctgccttggctaagacaggccgaggataagctggacactctcaagccttcctcgttccaacgtaaacacatcgagaagcagctgaaggagctgcaaactttccgaaacgaagtgtggaagaagtccggagattacgaaaacaccaagtctctaggggattccttcttgagcgcttgcgatatagacaaagatgacgtcaagaacgaactcgctgatcttaaagatagatgggataggcttaacaatgacttgattctgagaacccaagctctcgaagaccaatcaagaaaactagcaaactttggcgagaatttgagagaccttcaacacagcttggagcggtgcgaagacaaattggcgtcacacgacgcacttggaggagcagcccgagatccaaagttgctcgagaggataaaagcactcagagaagagacggccaagctgaagaaaccgctgcaagtcgttcgtcaacaggctgacgatctgtgcaatgaagctggagagaacggcatcgacgcggtacaccttaaagatgaagttgacggtttgggagatcgtattgacgagctagccagcaaactcgatgaccgttgctcggacttacaatcagctgctactgcggtgactcagttcaatgatcaagtgaagggcatttcccaagacctttctgctttggagtctgagttggacaacatgagaccacccggtagagacgttaagactgtacgtggacaaattgatgacgtcaacaaattcatcggaaaaatcaacaaagccactgacgacttgactgatgccattcaatccggcgagaggcttgtagacagcggatttgctccggatacggcccaaacaagacaacaggtagacacgctcaagaaattacttggtaagttagatgaccgtgcactcaatagagaaaaagaactcgatggagctttgaagaagctagaagggttttacattacccacgcaaacgctatagatggcatacaaaatgccgcatcagaacttcgtaaactcaagccagtcgcttccgaggtcgacactattagagcacaacaaaaagactttaagaagtttactgccggcttcattgaacctttgggtagacaaatcgatgaggtcaacaaagtgggtcagggactcatccagtctgcagccccaggcatcaacactaccgctctcgagaaggacctggagaaaatgaacgggctgtggaacgatctcaaagaaaaaattaatgacagagagagaaggctagatatcggcttgctgcagtcaggcaagttccaagaagctctggacggtctagccaaatggttaactgacactgaagagttggttgcgaatcaaaaaccaccatcagcagactacaaggtggtcaaggcccaactgcaagagcagaagttcttgaagaagatgttactcgacaggcaaaactctatgacatcgctatttaacatgggcaacgatattgctaaagaagcagaacctgcagaacgtaaagccatcgaaaaacaactgaaggacctaataggtcgcttcgatgcactcacagaaggggcacagcaacgtaccttggacttggaacaagccatgcgggttgccaaagagttccaggacaagttgattcccttacaggattggctggaccgctcagagaaaaaagtcaaggacatggagctcgtaccaacagatgaagaaaagat

SEQ ID NO: 1101 - DNA, 2167 bp, Leptinotarsa decemlineata
acagatgaagaaaagattcaacaaagaatacgggaacacgacgctctacacaacgacatattggataagaaaccagacttcaaagaactcaccgaaatcgcgtcaaatctgatgtctctagtcggagatgatgaagccgcagggctagccgacaagctacaagaagccaccgacaggtatggcatcctagtggaagccagcgagaacataggtcagctgctaacagcctctaggcaaggtcttagacatctcgtcttgacctaccaagatttggccgtctggatggatcagatggagcaaaggcttgcgagatacaagattctagctgtgcacaacgagaagctacttgagcagatggacgacttgacaaacttgtccgaagacatagctggtcgacaaactgacatagacggcaccgtagatgctggggttgaacttatgagacacatttcctcggacgaggctttgcagcttaaagataagctggattccttgcagcgcagatacaacgacctcacgactaaagcggcagagctgctcaaacaagcagaaacgatgctaccgctggttcagaagttccacgtcaaccacaaccgattagtagattggatgcagggcgcggagtcgattctgcagtccgccgaaccgtacgaaggagatatcgcccgactagaagtagatcttcaggaactgagacctgtactggagtccgtaaacattctgggaccgcagttgtgccaagctagcccgggagagggcgctgcgacaatcgaaggcctggttacgagagacaacaggcgctttgacgccatcgctgagcaaatacaaaggcgggccgaaagaatccacctgggtaagcagagagcgcttgaagtcacgggagatatcgacgagctactggaatggttcagggaagtcgacggtcagctaagagacgccgaaaaaccctctgcggagccagatctgatcaggattcaactaaaagagcacaaagcgctcaacgacgacatctccagccaaaaaggcagggtgcgtgacgtgctctcaactgccaagaaagtcttgcgggagaccccgccaagcgacgatacttcattcatccgcgagaaaatggatgaccttcgtgaagccatggacatcgtttctggtttgagctcggacagattgggagtgttggaacaagccctgccactagctgaacatttccacgaaacgcacaacgtgctagccacatggttggcagacatggaggagcaggtgtccatgctcaccatgccggcgttgaggcctgacatcatagcgcagcagcaggaccgaaacgagatgttcctccagtcaatcaacgagcacaaacctctcgtcgacaagctcaataaaacgggagaggcactcatcaggctatgcaatgaagacgacggaagcaaagtgcaggagttgctagatagcgacaacgccaggtatggagcgctcaggttagaactccgtgagcgacaacaggccctggagcaagccctacaagagagctccaagttttcagataagctcgaggggatgttacgagccctttccaacacagctgatcaagttaaccacctagaacctgtttccgctcacgttcctaaaattaaggatcagatagaggacaacgacaaccttgctggtgatctggataagaggaaggaagcgtacgcggctgttaaacgtgctgcagacgacgtcatcagcaaagcgggcaacaaagccgatcccgccatcaaagatatcaaacgaaagctcgacaaactgaaaaatctctgggatgatgtacagaaagctactcaggatcgcggaaggtccttggacgatgcgttggatgccgcccagaaattctggaaggagctccacgccattatggtcactctcaaggatcttgaagattctttggtatcgcaggaacctccggctgtcgagccgaaagcgatacaagaacagcaggtggctctgcaggagatcaggcaagaaatagatcaaaccaagccggatgtggataaagtgaggagttccggagaaaaactaatgaaactatgcggagagcctgacaagcctgaagtcaaaaagcatattgaagatttggacaatgcctgggataacattactgctctgtatgcgaagcgcgaggagaacctca

SEQ ID NO: 1102 - DNA, 295 bp, Leptinotarsa decemlineata
agcgcgaggagaacctcattgatgccatggaaaaagcaatggaattccacgaaaccttagagaatcttctcgagttcttggataaagctgaaagaaaattcgaaaaattgggtccactcggaactgatattgatgctgtgaagaaacagatcaaccaactcaagaacttcaaggatgaagttgatcctcatatggtaaaggttgaggctctcaacagacaagctcaagaactcacggaacgcacatcggccgatcaggcagcctcgatcaaagaaccgctgtcagctgtcaacaa

SEQ ID NO: 1103 - DNA, 1079 bp, Leptinotarsa decemlineata
gctgtcagctgtcaacaaacgatgggacgacctactgcgaggcattgtggagagacaacggtctctggaaaatgccctcctgcgtctcggacaattccaacatgctctcaacgagctactggtttggattggtaagaccgataaaacattggacgagttgaaacccgtggctggcgatcctcagattctggaagtcgagttggctaaattgaaggtactcatcaatgacatacaagctcaccaaactagcgtcgatacgctcaacgacgctggtaggcagataatagagagtggagctgacgaagcgagcgccacccaagaaaaactaaacaccttgaacgtccaatggcgctcccttatgcaaaaggctgcggaccggcagcgagaactcgaagatgctctgaacgacgcccaaagattcaacgccgaaatccaagacctcctctcctggttgggagatgtagacagcatcatcacggccagcaaaccggtcggcggccttccagaaaccgcctctgaacaactagaacgcttcatggaaatatacaacgaaatcgaggacaacagacctaaagttgagaccatcctctctcagggacaagaatatttgaagaaggccaccacgccagcttcaaacttacagcataatctccgcatgctcaagcagcgctgggataacgtcacctctagagctaacgataagaaaatcaaactggaaattgccctcaaggaagccacggagttccacgagtctttggaggcattcgtggactggctgacgaacgcggagaagattcttaccaacttgaagccggtgtccagggtcatggaaacgatccagggtcagatagaggagcacaaggtgttccagaaagacgtcagcgctcaccgcgagataatgctcgccctggacaagaaaggaacgcatctgaagtacttcagtcaaaaacaagacgttattctgatcaagaatctgttgatcagcgtccagcacaggtgggagcgtgttgcctcgaaatcggcagagcgtacgcgtgctctggatctaggtttcaaggaagctagggagttccacgacg

SEQ ID NO: 1104 - DNA, 401 bp, Leptinotarsa decemlineata
ggagttccacgacgcttgggccggactgatgacttggctagacgacacagaacacgcgttggatgaattcctagccgaggcgattggcaacgatcccgataagatcaagagtaggctaacgaaacaccaagacttccagaaagctctatccggcaaacagggtacctacgacggcgtgatgaaagccgggaaacaattgaaagacaaagcacccaaagcggacgagcctactttgaaaaacatgctgtcagaactgaagagcaagtggaattcagtctgccacaagagcgtcgagaggcagagaaagctagaagaggccttgctgtattctgggcaattcaaagacgccatcgcggctctggtgcaatggctgcaaaaggcagaaaaggagctagcagaag

SEQ ID NO: 1105 - DNA, 857 bp, Leptinotarsa decemlineata
aaaaggagctagcagaagacaatctagttcacggcgatcttgatacggtgactcacctagtggacttgcaccggcagttcgagaaggaattggaaaaacgtaatgatcaaatggaatcggtcatgcgtaatggacaagaattggaacgcacagccaacaaagctgactcgatacaaatacgagcggaattgaacgagctcaccgagctctgggaaaccgtcactagcctgaccagggccaagtctgacagactccgagaagctttgaaagaagcagagcggctacaccgttccgtcaatatgatcctagactggctgtcagaagccgagatgaagcttcgtttcgttggtaacacccctgaagacgaagcgacagcctacgaacagctacgcgccctggacgaattcagagcccaactcggcgagaaagaaatcgagaaggatcaaactctactactggcacagaatatcctggccaaggcccatcacgactccatcaacgtcatcaagagctggatcaaggtgattcagaccaggtgggaagaggtttcccagtgggctttgcagaggcatcagaagctatcgcagcacatgcagtccttgcgcgatatggatgaatctctggaagagctcatccagtggttgctgggattggagaatacgctgatcgccctcaagcgagaagagctgccaatggatattccagcaacggaacagctcatttcagatcacaaagagttcatggagaatacgcaaaagaggcagattgaggtcgacagggtatgtaaagcgaaacaagtcaagactgtccaagccgtcaaagaccccaagaagtttgccaaaggaaagggccaaatg

SEQ ID NO: 1106 - DNA, 465 bp, Leptinotarsa decemlineata
atgacgtcatctctgagcaaccacacgtaccttagtagttacatatctctacttctgagagcagaaccataccccactagcagatacggacaatgcatccaaaccaacaacataatgggtatcgataatatctgcgagttggcggccaggttactcttctctgccgtagaatgggcgaggaatattccgttttttcccgatctccaggttactgatcaggtggcactacttagattagtttggtcagaattatttgtgctgaacgccagtcagtgttccatgccgcttcatgtggcgcccctaatagcagccgcaggactacatgcgtcacctatgtgcgcagatagggtggtacaatttatggatcacattaggatatttcaagaacaagtagaaaaactgaaggcgttacatgttgactctgccgagtactcctgtctaaaagccatagttctcttcacgact

SEQ ID NO: 1107 - DNA, 1117 bp, Leptinotarsa decemlineata
atgtcacatactacacctagtatatatcctgctctgaataccaatatcgggcacaattcgtaccaaggtatccaaagtggtactactaatatatctggtacatatatgtcacaaaatccagttggcgttggctataatccaaaccatagtcagtacaacagcttgggccaccaatatacgaacaaaaatatgatggggagtactctgaatagtttaacacatcatccagttggaatgggatcgagtttgggacagtcaggagtactaggactacaacaatcaactttcaataatccaacgttcaacaatcctgttagcagtactctcacccaatacagcttgccttacaccaatcccatgaattccgtagttactacgagttacagtaacaacaacgtgacattttccaatccgcttagttctcagttcaatagtttacctcttaccggaggaccaatgagtattaagttgaaacaaatagacgacgtagatttgggtacccgtcgcgttgcaacccctgtaacaccccatccgcccccatggggtggtaccgtcatgtctggtatatcagatttgagaccgaggatgcttacagatggaatcgattcagactggagcggtttacatggtggcactgataggaacttcttgaatggacacaaccctgtcaataccgagggccaggttgacatgctagatattcctggaaaaggaagatgctcggtatatatagcaagattctcttacgatcctgaacccgaagtagaagaggaactgaacattcaagcaggagattacttattagtttggggcgaaccagttggaccaggaggatacttggatgctgaattgttagatggaagaagaggcttagtaccttctcattttgttcaacgtctcataggtgatgatcttctagagtttcaccaggcagtgttgagtactttgcgggaagaggaaatcaaccaagaaaattttgcggcagatgttcagcgactcaacgaactagctgagatggctgaagcacacgaagatgaagggcccgaaggtgagacagctgaccttttattctcggtgttagtgccggcccccaggcaactgactttggagaggcagc

SEQ ID NO: 1108 - DNA, 1373 bp, Leptinotarsa decemlineata
tgactttggagaggcagctcaacaagagtgttcttatttcgtggacggcgccagatggaattggtccaggaaatcaaatagaaagttaccacgtttacgttgatggtgtattgaaggccactattaaagctacggaaagaacaagagcattagtggaaggagtggatagcaacaggccccatcgtataagcgtgagatctgttactgcaaatcgtagaacatctagagatgcagcttgcaccatgataatcggtagagatacgcactctttaggacccagtgcggtgcgtgcatcgaatattacatcaacatcagctgtaatgagttggttgcctgccaattctaaccatcagcacgttgtttgtgtgaacaatgttgaagtcagaaccgtcaaaccaggagtgtatagacatacgataactggtctggcacccaatactcagtatagggtaacagtgagggcgaaacatcatagagctgctcagaacgtcgctaacttagctgaggaactgccaatgccagcagctgctcatacagattttagaacgttgccaaagggtcttcctgatcctccgagcgatatcttagtggaaccaggtccacaggatggaacgcttctagttacttggcatcctatactcaccccgcatcacccaggttcttctataaccggttacgccgtatttgcagatggtaaaaaaccccatcgtataagcgtgagatctgttactgcaaatcgtagaacatctagagatgcagcttgcaccatgataatcggtagagatacgcactctttaggacccagtgcggtgcgtgcatcgaatattacatcaacatcagctgtaatgagttggttgcctgccaattctaaccatcagcacgttgtttgtgtgaacaatgttgaagtcagaaccgtcaaaccaggagtgtatagacatacgataactggtctggcacccaatactcagtatagggtaacagtgagggcgaaacatcatagagctgctcagaacgtcgctaacttagctgaggaactgccaatgccagcagctgctcatacagattttagaacgttgccaaagggtcttcctgatcctccgagcgatatcttagtggaaccaggtccacaggatggaacgcttctagttacttggcatcctatactcaccccgcatcacccaggttcttctataactggttacgccgtatttgcagatggtaaaaaagtaacagatgtggatagtcccaccggagatcacgctttgattgatataagcaaacttctggggttgaatcctaaacacgtgacggttcgtacgaaagctagagacagccaatctgctgatagcgttcctactccgattccactcagc

SEQ ID NO: 1109 - DNA, 436 bp, Leptinotarsa decemlineata
atgttgacgcagaaactctaccccgacgtgaactccatgtcgacgagcacgaatgctatgtcccccatgaccccgacatactccatgaattcgatggcgatggcccagatgaactgctcgccgcagactcccatgttcggctccagcatgctgaactcgggcatgtcgggtccgatgcccatgaacaggatggccccgaggatagaccagactatgaacgacacctcgcagctggggtacaccacgatcggctctccgatatcaaacatgaacgcagcttgcatgggcgccaccatgtcgaacatcaacaactacacgataggtaggggagacctggggggcggtgatacctccccaaacagcgccctgcaaagggccagagccgataaaacctaccgaaggtcctacacccacgctaagccgccctactcgtaca

SEQ ID NO: 1110 - DNA, 428 bp, Leptinotarsa decemlineata
ttccgttctacaggcagaaccagcagcgatggcagaattccatcagacactcgctgtctttcaatgactgcttcatcaaagttcctcgcactccggacaagccgggaaaaggttccttttggagtctgcacccggagtctggaaacatgtttgagaacggctgctaccttcggcgccagaagcggttcaaagatgagaagaaggaggtgattcgctcttcgcacaagagtccttctcacagcgttgacagcagcagcagctcggggaaaaagacccctctgcagcacggggatgacaaggctcaccacttggacaaggtgaacgacaacctggggaacatgctcagcatccaccccgggaagttggatgttgatcagatgaacatgttgaacgcgaatgagttgcataacatgcagcagcaccatcat

SEQ ID NO: 1111 - DNA, 347 bp, Leptinotarsa decemlineata
agcagcaccatcatcatcaggggatgacgcacgaagagctctcggcgatgatcaacaggaacaaccatctggctttgtctagcgagcaccaggcgatgctacaccatgctcccatggggcaccacctgaagcaggagccgacggggtacacgccctcgaatcatcccttttccattacgaggttgctgccgacggaaagtaagtccgatatcaaaatgtacgacatgcaatacgcagggtataatactctcagccctttgccgaattctatacattctcacgcgtctatagggaatgattattacaacagtccgtcgctgtatcacacgtcggggacgacgtcgttg

SEQ ID NO: 1112 - DNA, 987 bp, Leptinotarsa decemlineata
atgtgtttgtgtcgcggactaagtatttgtggagatggaacctttcatttcaaattattggtacctagtgttgccgccggtgccatcattggcaaaggcggcgaaacaattgctcagctacagaaagagactggggcacgcgtcaaaatgtccaaatcacacgatttttatccaggcatagaaccacagaacataaaagtacaagcatcactgcgaactcattcttcatttgttccaggcacgacggaacgagtatgcctaatcacgggcagcgtggaagccatcataaacgtcctgaatttcataatcgaaaagatcagagagaagcccgacctgacgaaggcgggcgataccgagagcaagatgcacgagcgtgacaggcaagtgaagattctcgtgccgaattcgacggcgggcatgatcatcggcaaggcgggcaactacatcaagcagatcaaggagtcgagcgggtcgtacgtgcagatatcgcagaaggcgaaagacgtcagcctgcaggagaggtgcatcaccgtaatcggcgataaggagcagaacaaacaggcctgtctcatgataataagcataggcagtacccatccaggtgctctgcctgtttcgaattatctcagcgtgatggaccagacgggcgcgacaaatgcgagtacaggtgttttcggggccattgggcaagttagtttgggggaatgtttaggtgcgaattctgccacccccaggacaaatctcgagaggtacgattctgcattcgatccgttcaggcaccaaatgtctgctgcgacggcccccatttctttgaacaacaacagtttcggtttgggtacgggacaacagatggctgtgcttagtaaaagtcccactcccgcagaactgggcagcagcaaagacaccaaaaacgtcgaaatagccgaggttatagtcggtgcaattttaggtccaggtgggcgttcacttgttgaaatccagcagata

SEQ ID NO: 1113 - DNA, 201 bp, Leptinotarsa decemlineata
gttgaaatccagcagataagcggtgccaacatccaaatatcaaaaaagggtattttcgctcccggcacccgtaaccgcatcgtaaccatcacgggcaacccacaagccatcacgactgcgcattacctaatcgagcaacgcatcagcgaggaagagatgaaaagagcccggaacaacggccttggcactctggcgatgcag

SEQ ID NO: 1114 - DNA, 477 bp, Leptinotarsa decemlineata
atgacgaactccaaaggttaccgtcgcggtacgagggatctcttcgcccgtaaattcggcaagcatggagtcatcccgctctccacatatatgaaggtctataaagttggagacatagtagatatcaagggaaatggagctgttcaaaaaggcatgccttataaagcctaccacggaaggaccggccgtgtatttaacgttacagcacacgcgctgggagtaatcgtaaacaaaagggttcgggggaagatcatccctaagagaattaatatccgcattgaacacgtcacccattcgaagtgcagggaggatttcttgcagcgagtgaagtccaacgaaaagcttcgcagagaagctaaggagaaaaatgtcaaggtagagttgaagagacagcctgcccagcccaggcctgcacacatcgtcagcggaaaggtgcctgccgtgaagcttgcgccaattccatatgagtttattgct

SEQ ID NO: 1115 - DNA, 667 bp, Leptinotarsa decemlineata
atgtcacagttcaagttttggaacgaagttaacaccatactgacgatggacggtcccgtcaacggtccagtgcctcgatggcagaaaaaaagagaccctggatcatcaaacagcagttccaacaactcctcgaagctgagatcgctgtcttcttcggctctcaattcgacgaaaacaccgataaaaggtaacgaaaatgatcctctgagaagcaagactccgtcaaaaaccccaaagaagtcaaaaacccccacacctcacaaatcagcgagaacgcctggtggagaccgtttcatcccttcacgaagtgccagcaactttgaactggcacactacaagctcacgcaggatgaaaacgaccagagcgacagccctaccaggaaggaactacagcggttgatgtcagagaacttacgaggaggcgacatcaacaatcagcgtatactgtcttacaaaaacaaggctccttcagcccctgaagggtttcagaaccctatgagagtcatttacacacaggccaagacacctgcctctacgaaaggcagcagatacattcctcaggctcccgatagaattctggatgcccctgatattgttgacgactattacctgaacttgatcgactgggggcctaataatattctggcagcagctctgggcgctcatg

SEQ ID NO: 1116 - DNA, 897 bp, Leptinotarsa decemlineata
gctctgggcgctcatgtttatttgtggaatgcaggaaccggcaacattgaccagttactggaattagaaggtaacgactacgtttgctccctatcctggacccaggatggaaactgcttagccgtgggcaacacaaacggtaccgtggaactctgggactgtgaaagagccaagaagctgcgaattatggaaggccactcggctcgagtcggctctctatcttggaactcttttgttctatcgagcggttgccgtagcggacagatcattcatcacgacgtacgacagagggaacatagaatcggtatactatcaggacacactcaagaagtctgcgggctcaaatggtccacggacgggaaatatttggctagcggtgggaatgataacgttctgaatatttggcaggcggttaacggagggtatcattccaacaccacccctctgcacagtttcacgtcccatcaagcagccgtgaaagccctggcatggtgcccctggcaaccacatttactcgctagcggaggagggactgcggatcgtcatatacgattctggaactgcaatacgggagcttgtgtaaatgcaatagacaccagatcacaggtgtgtgccttactctggtccaccaattacaaagaattggtctcggggcacggtttcgccaacaacgagatcatcatctggaagtatcccggaatgacgaaagtgactgagctcactggacacaccgcgagagtgctgcacctcgccatgtctccagatggatctacattcctgtcagctggagcggacgagaccctgaggttgtggaagtgcttcactaagagcgtgacaaagagcagtaatgcagagaaagtgagggcgaagcccagtgcactaaaacagtgcataaga

SEQ ID NO: 1117 - DNA, 2904 bp, Leptinotarsa decemlineata
atggacgaatcctcaaaccgcggtctttcgcgtccgatgtctagtgctgcaattgcaggcagctccgtcgatccaccagcaaagaagcgaaagctcgaaacttcaaccctcgaaatggcgaacagttcaggaccgtctcgagccagcgaaatcgacgaggggctgtattctcgccagctctacgttttgggacacgacgcaatgcgtcgtatggctaaaagtgatgtactcatatcgggcttgggggggctgggagtggaaatcgcgaagaacgttatcctggggggcgtcaaagcggaggcttgttgcaaatctctgtcagaactcaataactatgtacccacgaaggcgtacacgggccctctcgacgaacagttcatcaaaaacttcagcgtcgtggtccttaccacgagttcaaggtctgaacagctgcgcatcagtgaaatcactcactcaaataacatcgccctgattatcgcagatactaggggcttattcgcccaggtgttctgtgatttcggggagtctttcaccgtcgttgataccaatggggaaccgaccgtttcggcaatgattgctgatatttccaaagataaggaaggtgttgtcacctgtatagacgataccaggcatggtatggaagacggggattacgtgacattctccgaagttcaaggcatgacagaattgaataactgcgagcccatcaaaatcaaagtactgggaccctatactttcagcatcggcgacactacatccttcgggaaatatgaaagaggcggtaacgcatctcaggtcaaaatgccaaaagagctgcatttcaaacccctcaaagaatcgctgctggctccagagttcgtcataacggatttcgccaagattgacagcccccagcaactccacttagctttcaccaccctccacaaatacgtcgagaagaacggtagggttcccaaaccttggagcaacgaagacgctgacgagtttgtttctttggcaaagtctatagctgtagacggttcaaatgatactgaagtcaatggtagtttattggaaacgtttgctaaagttgcggcaggagatttgaatccgatgaatgccacgatcggaggcgttgtggcccaggaagtgatgaaggcttgctccgggaagttccacccgatttatcaatggctctatttcgattcgatcgaatgtctaccccaagatcgttctgaaatcacagaagaattagctgctcccttcggcagtcgttatgatgggcagattgcagttttcggaaaagaattccaaaagaaactagccgcactgaaatacttcgtagtcggcgctggcgccataggatgcgagcttttgaaaaattttgcaatgatgggtgtgggcactgagggacaaataacggtgacggatatggatttgattgaaaagtccaacttgaacaggcagtttctgtttagaccccacaatgtgcagcagccaaagtctgctacagcagcaaaggtaatcaaaaagatgaaccctgaagtaaacgtcgtggcccacgagaaccgcgtaggcccggagacggaaagcatctacaatgacgctttcttcgagaaacttgatggcgttgccaacgccttggacaacgtcgacgccaggatatacatggaccgcagatgcgtctactaccgcaaacctctgctggaatctgggacgctcggtacgaaaggcaacactcaagtcattgttccgttcttatctgagtcgtacagctcgtcccaagacccccctgagaagagcatacccatctgcaccctgaagaacttcccgaacgccatcgaacacactttgcagtgggctcgcgacaacttcgaggggctcttcaggcagaacgccgagaacgcgtcgcagtacttgaaggatgccggtttcatcgatcgcaccctcaagttacctggagtgcagcccttggaagtcctcgaatcggtcaaggcagctttggtcgacgagaggcccaaatcttttgaagactgtatcgcctgggcccgcaaccactggcaggagcagtactcgaaccagattaggcagttgttgttcaactttcctccggatcagctcacaaccaccggccagttgttctggtcggggccaaaacgttgcccggaagcgctcactttcgatatcaataatcctctccatttggattacgtccttgcggcagctaatttgaaagcgcaggtgtatggtattccgaccaacagggacagggcatatattgctgaagtggtcagcaaggttgaggtaccagagtttgtgccgaagtctggcgtcaaaatagctgttacagactcccaaatggccatgaacggtaacaacgtcgacttggatcgagtaactcaaattaaagaggagctaccctccgtcgaagaactgaacgggctctgtcttactccgctagaattcgaaaaggacgacgacaccaatttccacatggatttcattgttgctgcttctaacctccgagcagcaaactataaaatacctcccgcagacagacacaagtctaagctcattgcaggtaaaatcatcccggctattgctaccacgacatccgtcgtaggggggctcgtctgcttcgagctgtacaaactgacacgaagcatgaagagtttagaaccattcaaaaacggctttgtcaacctcgcgctgcctttctttggcttctccgagccgatcgcggcccccaagatggagtactgtggcaacgagtggacactttgggatcgcttcgaggtccaaggagagatgacgctcagcgagttcttaacgtacttcaaagagaagcacaacctcgagatcacaatgctctcccagggcgtttgcatgctttactcgtttttcatggcaaaggccaaggcgcag

SEQ ID NO: 1118 - DNA, 723 bp, Leptinotarsa decemlineata
atggtgcttatagctgcagcagtctgcacaaaagcagggaaaaccattgtgtctcgacagtttgttgaaatgaccaaatcgcgaattgaaggattactggctgcttttcctaaactcgtacccacaggaacccagcatactttcgttgagacggactcagttcgttatgtctatcaacctcttgaaaggctttacatgttacttataacaacaagagctagtaatattttggaggatctagaaactttacgcttatttgccagagttatccgtacattcgtcgagatggattcacatgaagagaaggtttatcaagcagtaagacagactcaagaacgagaagccaaaatcaaaatgagagaaaaggcaaaagaattgcagaggcagagaatggaagctaaaaaaggtaccaaatcatcatctactaacagcggaggttttggcaattcaggaagctatacacctacgccattcgtcgtcgatgcttccaatgtttctaatgatgtgaaaccaccttcatacgcagctcctattcaaaaaccaaaaggtatgaagttaggtggaaaaggccgtgatgtggaatctttcgtagatcagctgaaatctgaaggtgagaatgtcatcattccagccaagaacagtatttctcaaccaggatccaaagctccagccatcaaaaccgacattgatgacgttcacttgagattagaagaaaaattagta

SEQ ID NO: 1119 - DNA, 674 bp, Leptinotarsa decemlineata
tagaagaaaaattagtagttaggttgggccgtgatggaggggttcaacagtttgaagtgttaggacttgcaactttacatattggcgatgagaggtggggaagaattcgtgtgcatcttgaaaatcagaattctcatggagttcagcttcaaacacatcccaatgtggataaggaactcttcaaattacgttctcaggtaggaattcactacgttggtgtactcaaatggagattgcaaagtacggaagagaccctggtaccacttctcataaattgttggccctcagaagccggagatggaagttgtgatgttaatatagaatatgaacttgcccacagtaatttagaacttatcgacgtcaatattaccattccgttgccaatcggttgttcccccgtagtcggggaatgtgacggcacatactcgcacgaatccagaagaaaccaacttgtttggaatttgcctgttgtcgactttagcaacaagagcggatctttagagtttagcgctccgaaagctattcctaatgatttctttccgctttctgtggctttcacgtctaaatcttcatacgcaagtatcaaggttaccgaagttactctcatagatgacgattctcctgttaaatattcggtagaaactgtgttgtatcctgataaatatgaaatagtg

SEQ ID NO: 1120 - DNA, 421 bp, Leptinotarsa decemlineata
ttgtttgatataatgggaaacacggtttcagctgcagagattgctgcagcacaaatactccgcccaaatgatcccattgaaaaacatcgtcatatagatatccataaatttgagggagaaattcccccagaatgtccgatgcatcagaagtccaaatcgaagacatttagttcggaatgtcctgttggaggaatgagcgatgagttaaatcctttgaatatgatgggtcctgccaatcaaagtccttctccaggtcaaccttttccattatcaacccatagggaagtttctacaattccgaaggctatagtcaaggaaggagaaagtcaattctggacatatccaagcccgcagatgttctggaatgctatgctgagaaaaggttggcgatggaaggaagaggacattaaacaaaaagata

SEQ ID NO: 1121 - DNA, 329 bp, Leptinotarsa decemlineata
acattaaacaaaaagatatggataatatcattaaaatccacaatgctaataatgaacaagcatggcaagaagtattgaaatgggaagcacttcattacaatgagtgtaaagatcccagactgaaaagttttggaggaaaagcaacagattatagtcctcgagcaagaatgagacaacttatggggtacgaactaccattcgacagacatgattggatagttgacagatgtgggaaagaagttcgatatgttatcgattattatgatggaggatcagtagatgataaatataaattcgcccttttagatccttgtttgggatatactgcc

SEQ ID NO: 1122 - DNA, 1059 bp, Leptinotarsa decemlineata
atgtctatcacaaaacttgaagttttcataaatgatctgattgtcatcgtgatatcccactttttcattgagtttttgctgacattttgggtacattccacaggtttcctgaatgcaaaccctgcgccacacctcaaagctcgcgtcgcaaactacgggctcatggaccaaatagcagcgctccattggattcagcagaacatagctttattcggcggtgatccagacaacgtcaccatggctggacatgggtctggagctgcttgtataaattttcttatgatatcaccaacggtgatgcctggtctcttccatagaacgattctcttgtcgggatcagctctttcatcttgggcattggttgaagatccggtcaactatgccgtcaaactagccaaagaagtcaattgctccattccagaagacgtcggaaaagaccatgaagccattgtggactgccttcgcgacacacctctggaagaactcctccaagccgacgtcatagccccagcgtacctcagcgcattcggtcccagcgtagacggagtcgtcatcaaaacggactttgccaaagaactggtaacgtacttcaaaccacaagacctgcagaacttcgtaggaccggtcaacgccaacatgaagagaagtgagaccactctgaccccgaagggcaacaatccctacgacttgcttttcggcgtagtgactagtgaggcgctgtggaggttttcgaacaccgatgtgtctgccgggttcgagggggaacgcagagacaaaataattaggacttacgtgcggaacgcttacacttatcatttgagtgaaatatttttcacggtagtgaatgaatatacggattgggagaggacggtgcaacaccctgtgaatacgcgggactctgccattgctgcgcttagcgacgcgcagttcgtagctccgttggtgcaaactggggatttgttgagtgctaagcctccacagcccggtcaggaagcgactggccccaagacttttttctacgtattcgattatcaaacgaaagatggagattatcctcaa

SEQ ID NO: 1123 - DNA, 768 bp, Leptinotarsa decemlineata
ttgtgttcacctcgtgtctcttcctttgctgctggaaccccgttcaaaatggcaacgaatatttcaaagaagcgcaaattcgtagccgatggagtctttaaggctgaattgaatgaatttctgactcgggaactttccgaagatggatattctggagtggaagtacgtgttaccccaacgcgtactgaaattatcattatggcaacgagaacagacagagtcttgggcgagaagaacagaagaatccgcgagttaacttcagttgtgcaaaagagattccgtttccccgagaactccgttgttttgtacggagaaaaagtagcaaaccgtggtttgtgtgctatcgcccaggcagaatccttgaggttcaagcttattggaggtcttgctgtaagaagagcatgctatggtgtcttgaggtatatcatggaatgtggagctaaagggtgtgaagtagttgtatctggaaaactacgtggtcagagagcaaaatctatgaaattcgtagatggtctcatgattcattcaggagatccatgcaatgactatgtagacactgccacccgccacgtattgctgcgacagggagtgctgggaataaaagttaagatcatgttgccttatgatgccacaggcaaaattggtcccaagaaacctttgcccgacaacatttctgttgctgaacctaaggatgaggttttacctttataccccagcagcgaggtgaagacagtgaagcctgatgcacctgttcttccggttcctgtt

SEQ ID NO: 1124 - DNA, 567 bp, Leptinotarsa decemlineata
atgaagcagattgtaacaaaccaaatcgtcaaaatccctgaggggatcacggtcactgccaaatcccgtactatcacagtaaaaggacctagaggcaccctgaaacgctctttcaaacatttggctttggatattcgtatggttaaccccagaaccttgagagtagaaaaatggttcggtacgaaaaaggaattggctgctgtcaggacagtgtgttcccacgtagaaaatatgttgaaaggtgtaacgaaaggttaccaatacaaaatgagggccgtatatgctcattttcccatcaattgtgtaaccacagaaaacaattccattattgaaatcaggaatttcttgggtgaaaagtatatcaggagagtcaaaatggctccaggtgtaacggtcaccaactcccagaagcagaaggatgaactaatcattgaaggaaactctttggaagacgtatcccgatctgctgcactcatccaacagtctacaaccgtcaaaaataaggatatccgtaaatttttagatgggttgtatgtttctgagaaaacgactgttgttcaagacgaa

SEQ ID NO: 1125 - DNA, 640 bp, Leptinotarsa decemlineata
ttggaaccagtaatcctacagtcctttccgtttagtgaaacgttgagaatagacatgtcgttgcaagatagacgtgaagagtgggacaagaatggccctaccaatgatgaaaaagaatcacaaggatacgatggccctccagggatggaccctgatggtgtcatcgaatcaaactgggaagaggttactgacaacttcgacgatatgaacctaaaggaggaacttctcagaggtatctatgcatatggttttgaaaaaccctcagctattcaacaaagagccattatcccttgcgtgaaaggtcatgacgttattgctcaggcccagtctggtactggaaagacagccacattttcgatatcaatcttgcagcaaattgacacttccgttagagaatgccaagctttgattttggcccccacacgtgaattggctcagcagatccaaaaagtagtaatcgcattaggagatttcatgtctgcacagtgtcatgcttgtattggtggtacgaatgtcagagaagatatgaggaaactcgaaacaggtgttcatgttgttgttggtacacctggtagggtatatgatatgatcactcggcgagctttgagaacaagtcatattaagatgtttgtactggatg

SEQ ID NO: 1126 - DNA, 534 bp, Leptinotarsa decemlineata
ttatattactatctgctaccatgcccaacgatgtcctagacgttacaaaatctttcatgagaagtcctatcagaatcttagtaaaaaaggaagagcttacactcgaaggtatcaagcaattctttgtatatgttgaacgtgaagactggaaattggagactttatgcgacttatatgataccctttcaattacgcaggctgtaatcttttgtaatacacgtcgcaaggtggactggcttacagagaacatgcacaagcgtgattttactgtctctgctatgcacggagatatggagcagagggaacgagatgtcattatgaggcaattcaggactgggtcttcaagagtactcattaccactgatctattggcccgtggtatagatgtacaacaagtttcactagttataaattatgatttgccttcaaatagggagaactacattcataggattggtcgtggtggtagattcggtcgtaagggtgtagccataaatttcgtgacggaagaagacaaacgtacacttaaggata

SEQ ID NO: 1127 - DNA, 226 bp, Leptinotarsa decemlineata
acctgtttatctaccacctgccccaagaattcactgacacggacctggcgtcgactttcctacctttcggtcctgttatttctgccaaggtgttcatagacaaacagacgaacctgtccaagtgtttcgggtttgtgtcgtttgataacgcccaatccgctcaacaagccatatctgcgatgaatgggttccaaatcggtaccaaaaggctgaaggtccaactgaa

SEQ ID NO: 1128 - DNA, 453 bp, Leptinotarsa decemlineata; identical to SEQ ID NO: 969

SEQ ID NO: 1129 - DNA, 857 bp, Leptinotarsa decemlineata
accagtttgcatggccttttcaacaaccagtcgatgcaaagaaacttaatttgcctgattaccacagaataataaaacaacccatggacctgggaacaataaagaaacgtttagataacaattactatttgtcgggtaaagagtgcattcaagattttaatacaatgtttacgaattgttacgtttacaataaaccgggagaagatgttgtcgtaatggcacaaactttagaaaaagtgttcttgactaaagtagcggacatgcccaaagacgaatttgtagtggaaacacctacgaaaggactcaagggaaagaagggaagaacaagtacaggccctgctggtcctgtttcaagtgtgggaaggggtagaccacctgcgacagtatcttcaaccagtgctacaccagtggctactactacaggttcctccggcctgcctttgggaactcaggctccggcaactgtccctggtagcaccgccaccacaacgatagctcctgctaccactaatagctctcttccttctcaacctccagcacaaccttccaattttcatggtgcaccctccatagttaattctttagattcgaatgtgaatccgggggtgctaccgggaagtgttgtacctccttcacaaccagctaaggtgaaaaaaggggtgaagagaaaggccgacactacgacacccacggctactgcatatgattatgcaccaccgttggagtcaaagtcggcaaaaatatcaacaagacgtgaatcaggtagacagatcaagaaaccggtaaggccagaattggatggccatgttccccagccagcatcacagaaactgaaagagaaactttctgaatctttg

SEQ ID NO: 1130 - DNA, 554 bp, Leptinotarsa decemlineata
actttctgaatctttgaaagcgtgtaatgaaattttgatggaattgttctccaagaagcatgctaattatgcttggccattttatcagcctgttgatgctgacttattggggttacatgactatcacgatataataaagagacccatggactttggcacagtcaaacaaaaaatggataacagggagtatcgtactccacaagactttgctgccgatgttagactgatttttaccaattgttataaatacaacccttcagatcatgatgtagttgcgatggctagaaaactacaggatgtatttgaggttaagtttgctaaaatccctgacgaaccactaaataggataggtggtagtgctgcagtatcgactttagctgtaaaatctgaatccagtagttctggttcaagttcggagtcatcgagtgatacagaggattctgaagaagaaaagcggaacaaacagttgaagttattagaaaaagaactgacggcaatgcaggaaaaaatgaagaaactcgttgaggaaagcacgaagaagaaaaaagaaaaga

SEQ ID NO: 1131 - DNA, 483 bp, Leptinotarsa decemlineata
aaaaagaaaagaaaaagaccaaggtgaaaccgaaaaaacctcccgcagcagcattgccaaatagtagtagcagtattggtaagcctggagcgcacggggctctaaacaagcccaactcccttgcagacagcgttgacgacagcatcgccagtgttgtgtcgggggctgatctcaagattgccgccgaggcacatcatccgacggccaacaagtctctcaacatgcaccacaacatggcggctggcgccaacgcttctgcccaagctaaaactcctaaaagtaaaggtttaagaggtaacaaacctgcaactactcccagtgccccacctaaacgagtgaaagcaaacaataaggctggcccaggaaggaaaaaatctgcagcccaaccacctccagcacagtgtgaatctgaggaagaggacaacgcgaaacctatgtcttatgatgaaaagcgtcagctgtcattggatattaataaattac

SEQ ID NO: 1132 - DNA, 766 bp, Leptinotarsa decemlineata
atgtggccaactcaaacaagtccacaaaacagagagaatcatgctcagcgaaatgatgaaaaactcacaactctggggatgacatctgcaatatcgactgctggtcctaaaccatcagatttaataaagacgaaagaactagaagaatcattgaaactattcgatgtgttcgaatctgaacaggaacttaatcagcgcatttatattttaggaaaactatataacctagtcaagcaatggatcaaagaagtttctataaaacgtaatatgcctgaaagtgtagcagaacaattggggggaaaagtttatacattcggtagttacagacttggtgttcacagtaaaggtgcagatattgatgcactatgtgttgctccgagacacattagcagaactgaattctttacttctttttatgaacttctcaaggcacaacctgaagtatctgagctcagggcagtggaagaagcttacgtgccagtgatcaggatgaattttgatgggattgagattgacatgttatttgcaaaactatcactgaaagaaattccagattcaatagatttacgtgatgatatggtactgaaaaatttagatgaaaggtgtgtacggagtttgaatggttgtcgagtgaccgatgagattttgaggctagttccaaacatagaaaactttagacttgctttaagagctattaagctatgggcgaaacgacacggcatttacagtaacgttctaggatatttgggtggtgtttcctgggcta

SEQ ID NO: 1133 - DNA, 1043 bp, Leptinotarsa decemlineata
gtgtttcctgggctatgctggtagcaagaacgtgccagctgtatccaaatgcggcaccttcaactctagtgcataagtttttcctaattttctcgaaatggctgtggccacagcctgttttactgaagcaaccatctaatgttaaccttggattccctgtgtgggatcctagggtaaacattcaagatcgttatcacttgatgccaattatcacacctgcttatcctcaacaaaattcaacattcaatgtgtccctttccacaagaacaataatgattgaagaattcaaacaaggtttgtctattactgatgatattatgctcggaaagagcagttgggacaagttatttgaacagccagcatttttcacaaaatacaagcattttattgtactactagtaatggcagaaaatgcaaaagatcatttggagtggtgcggactagttgaaagcaaagctaggattcttgtaggatatctggaaagaaatcagtacataacccttgcacacatcaatcctgaaagctactcaatgctggagtcccaaagggaacctaacacaatttgttctatgtggtttattggactggaattcgctaagacagacttgagtgttgaccttacaagagatatcaaatcatttatggatcacgtcatcaagcatgcaataaatattcaggctataaaagatggaatgactttggatgcaaggcatgttaagaggaaacagttgtcacagtatttggcgccaggccttatcaaacgagaaaggaaatctggaattatcaagaacgatactaaccctgaaagtagaaagagaatgtcgtctgaagctattccggaaggagatacacccaataaaaagactaggctatctgaagaaattactccggctcatttcgacgaaagttcaaataactcgatcaacaatgactcaaacagcaacttcagcttagcagactcggagggtaatttgagcgggctctcagttgtcgatcccagtcatcctacagccagttccaatgtagcagaggctgtgtgtacc

SEQ ID NO: 1134 - DNA, 208 bp, Leptinotarsa decemlineata
cattcgcaaatagtgctgatgcggagcgcgcacgagaccgactacatggcaccgtggttgagggaagaaaaatagaggtaaataatgcaactgcaagggtacaaaccaaaaaaccaccaactcttcccacagttccagtaattcaatggtcggacgccacactacgagcaggggtagcagctattcagcgaggcagggcaagggcagc

SEQ ID NO: 1135 - DNA, 260 bp, Leptinotarsa decemlineata
cagcagccgcagcggcagcaacccccttactaaaaacacccctctcgactgcccaacaggcgagctatgcagctgcagcgacatacacggcggtggcggcgaggtacggtgctgcagcagccgctcaaccagtggcaggatatgcagttgcaggatacggaagagactatgcagatccttatttgggacacgggattgggccgatggctggatatggggccgctgtttatcgtggtggttacaaccgttttacgccctac

SEQ ID NO: 1136 - DNA, 632 bp, Leptinotarsa decemlineata
aatggcccaaatacattcgaattcaaaggcagaaggccgttttgcagaagagattaaaggttcctccgccaatcaatcagtttactcaaaccgttgacaaacaaacagccacccagttgttcaaactcctagagaaatacagaccagagacagctctccaaaaaaggaataggctgaaggctaaagccgaagctaaagtggccaagaaagaggaagcccctaccaagaggccaaacaccctcagggctggaactaacactgttactaaactcattgaacagaagaaagctcagctggtagtgattgcccacgacgtggaccctattgagttggtgttattcttacccgccctctgcaggaaaatgggtgtaccatattgcatagtgaaaggaaaagctagactgggacttttggtgaggcgcaaaacttgcactgcagtagctcttacccaggttgattctggtgacaggtccaacttcaacaaggttgtggaagtcatcaaaaccaacttcaatgatcgctcagacgaaatcaggagacactggggtggtggtttgttgggttccaaatccgcagctcgtatcgccaagatcgaaagggccagggctaaggaactcgcccagaaacagggt

SEQ ID NO: 1137 - DNA, 222 bp, Leptinotarsa decemlineata
ttccatagaggttatgttataaagtcgacccacaaaaagaagacaaggaaactaaggggacacgtaagccatggacatggacgtattggtaagcaccgcaagcatcctggaggtcgtggtaatgctggtggtatgcatcaccacaggataaactttgacaagtaccatcctggatactttggaaaggtgagtgataaaaataatatgcactctcatcacgtt

SEQ ID NO: 1138 - DNA, 1033 bp, Leptinotarsa decemlineata
ttgttggtagtgtcgaagtgtcggaaaatggcaaatttaaatttagataaagaaacttttcatcgccgattaaaaaagttatacaacgcatggcaaaattccgaaggcgaaaatggattttctaaaatggatgcactggtcacctccgtcggaaaagacgacgaaatcgtctacagcaaatccggcgccttgcaaacatggcttttgggctacgaactcaccgacactatcatggtctttaccgagaaaaaaacgtatttcctagccagcaagaagaaaatcgactttcttcgccaagccgactccaaagacgaatctcacgtacagctgggtctcctcgtgagggacaaagacagcgatgcagccaaattcgaaatattatgcaaagccataaaggagagcaagaatggtaaaactataggtgtatttgccaaagaaaactatacagggcctttggtagagagttggaaagctgccctcaagaagaatgagttcgagaacatcgatatgagctcgcagatgggctacctcatgagccccaaggaagactccgagattatcaccatcaagaaagcctgcatggtcacagttgatgtgttcacgaaatacctgaaggatcagataatggagattattgattcggaaaagaaggtaaaacacagcaagctggcggaaggtgtggagtctgcaatcaacgataagaagtatgtatcaggtatagacattaaccaagtagacatgtgctacccggctataattcaatccggaggtaattacagtttgaaattcagtgttgtaagtgataaaaacaatctgcactttggtgcaataatatgttcactgggagctaggtacaaatcctactgctccaatatcgttagaactctgctcgtaaatcccaccgagacaattcaaaataattacaattttcttctcaacgtcgaggaggaagtacttaaaaagctccaaaatggcgtcaaactttcggacgtatacgaagcaggcttcggatacataaagaaagaaaagccag

SEQ ID NO: 1139 - DNA, 328 bp, Leptinotarsa decemlineata
aaagaaagaaaagccagaactcgtggagcatgtgacaaagaattttggtttcgcgatgggtatcgaattcaaggagagctcattgatgattgggcctaaaagtaccgcgaaagccaaaaagggcatggtattcaatctcaacataggcttcggtaacttgcagaacaaggaagcctccgagaaagaaggtaaagtgtacgccctcttcataggtgacaccgttatagtgaacgaagaccaacctgcttctgtgctgacagtatctaagaagaaaatgaaaaacatcggtatcttcctcaaagatgattcagaggaggaggaggatgat

SEQ ID NO: 1140 - DNA, 774 bp, Leptinotarsa decemlineata
aggaggaggatgatgaggaaaaggaaaacactccaaagaagactgaagtcctcggcaggggcaagaggtctgcagtgttagattctaaactacgcacagagcatagtacagaagaaaagcgcaaggagcatcagaaggaattggcaacgttgttgaacgagaaggcgaaagaacgtttggcgaagcagtccggtggaaaggataaggaaaaagttaggaagaatacggtgtcatataaaagtgtgaaccaactgccgaaagtacctgaagtcaaggagctgaagttgtatgtagaccaaaagtatgagactgtgattttacctgtgtacggaattgctgtgcctttccatatttctaccatcaagaatatttcccagtctgtggaaggggattacacttacctgcgtattaactttttccatccaggatctgctatgggaaagggagagggagatatcaagtgctgggcaccacttgatttctgtattctttcaacaacggtttttctccatccatacattttttccaaactttttctcttaggaaactggtctcaaccagaagcgaccttcgtcaaggaagtgacctacagaagcttgaacacgaaagtacccggagaagtaacggccccctcttccaatttgaacaccgccttccgcctcatcaaagaagttcaaaggaaattcaaaacgagggaagcggaagaaaaggaaaaggaagacttggtcaagcaggacaccttggtcctgtcccaaaacaagggtaatcccaagc

SEQ ID NO: 1141 - DNA, 384 bp, Leptinotarsa decemlineata
gtaatcccaagctgaaggatctctacatcaggcctaacattgtgtcgaaacgtatgactggctccctggaggcccattcaaatggttttaggtattcggaaggtgtgcagtccttgaactgggtaaaaatcatgaaaaccataacggacgatccggaaggattcttcgacagcggtggctggactttcttggatcccgaatcggacgaagaagatgcacaagaagaggattccgaggaagaagacgaggcctaccagccttcggatgcaggcgaagagggctccgaatggagcgaggaagactccgaatactccgagggggacaccgaggatgatagcgggtcagaggaagatttaggttctgaggaagaatctggtaaagact

SEQ ID NO: 1142 - DNA, 422 bp, Leptinotarsa decemlineata
aatctggtaaagactggtcggacttagaaagggaggccgcggaagaagacagagaacgcgcgtatacgggcgacgatgataaatacgcttcctccaaaaataggcacaaaagttcctccagttctaaagacaaggatagaggaaagtccaactcgagccacaagagttcgagtaaacagtcttcgtctagcaagcattcctctccgaacaagcacagttctcgagacaaagacaaagaccgccacaagagcagcagtgaccgagacagagaccggcactcttcctccaagcacaagtcgtccaagagttcccttgacagaagttccgacaaggacaggagtaggagttcccattctagctctcacaagaagcgcagtagggatgatagtaaggatcgacatcattcaaagaaatccaaaaag

SEQ ID NO: 1143 - DNA, 585 bp, Leptinotarsa decemlineata
atgacacagtttttaccaccaaatttgttggcgttatttgccccacgagacccaattccttatttacctcctgtggcgaaattaccacacgaaaaaaagaacaggggatatttaggactggggcagtttctaagtgaatttgaggatccaaaagacacacctccaccaaccagagtcgaaactagagaagaaagactagagaggaggcgccgagaaagagctgaacaagtagcttataagttagaacaagaaatcgctatatgggaccctgcctcagcagcaaatattacagtcgacccatttaaaactttgtttattgctagaattaattatgattcctcagagtcgaagctacgaagagaatttgaagtttatggaccgattaaaaagattgtgctgattcacaacagtgtcaacgggaaaccaagagggtatgcttttatagaatatgaacacgaaagagacatgcattctgcttacaaacatgctgatggcaagaaaatagatggcaggcgggttttagtagatgtggaacgggcaagaacagtgaaaggatggcttccacgaagattgggtttttttgct

SEQ ID NO: 1144 - DNA, 690 bp, Leptinotarsa decemlineata
catatgcttttgttgaattcacaaaccaccagtcagcatccacagctttggctgccatgaacaagaggttgtttttagataaagaaatgaaagtgaattgggcgacaagtccaggcaatcaacccaaacaagacacatccaatcaccatcacatttttgttggtgatttatcccccgaaatagagactgacacattgagagaggccttcgctcctttcggagaaatatcgaattgcagaatagtgagagatccacaaacactcaaatccaaaggttatgctttcgtatcatttgttaaaaaagctgaagcagaaaatgccatacaagcaatgaatggacaatggctaggatcccggtccatccgtacaaactggtctacgagaaaaccaccaccgccaagaacagaaaagccacagcagcgtgctaaacaacctacctttgatgaagtttataaccagacatctccgaccaatacgactgtatattgtggtggctttacaaacggtttgacggatgaattggtacacaaaacctttgctccttatggagccattcacgatattcgtgtgttcaaggataaggggtatgcatttataaaatttgtaacaaaagaaagtgctacacatgcaattgagaatgtccataatacagaaataaatggtcagaatgtgaaatgtttttggggaaaag

SEQ ID NO: 1145 - DNA, 305 bp, Leptinotarsa decemlineata
aatgtttttggggaaaagagaatggaggcttaggacctgagtctggttcactaccccctggtgcaggggttcctcaatctgctggtccaccgtactcatatggatatggggggtattggggctatcctcaggggtatagtggaggtggatatgtacaaggttaccagccgtaccaacaatatcagcagtatcctggaggtcagcaatattgcgtcatgccgcagcagggacagtggtcaggacagccaggtcagcaaccaaatgtaccagtaatgtatagtaatgttcagaaatatccatctcag

SEQ ID NO: 1146 - DNA, 1359 bp, Leptinotarsa decemlineata
gaacctttatgtaaaagatggaagaggaagatctgctacgtcctccagcaagatatcttcttccctgacctaacgttaaggcaaaccttagagtatagcgcgcgactaagattacctgacacattgagccattcgcaaaaaatgcagtacgttgaccacataatcgatgtattagagctcggtaactgccaagagaccatcataggagacaacctcaacagaggcctcagcggtggagagaagaagagggccaatatagcttgtgaattgttgactaatccttcgttaatgttattggatgtgatggaacaaataaaaggaacttccgacacacgaaaaagacttttggctgcggccaaagaactaaggaaaagcaaggattaccctatagaactacagcacgattgttacgttaatgaaaaatatgataattcgaataaaatgttgctgccttctcatggaccatactcaagtttggaactcagttcagaaactagcgacgcagattgttatttcacctggcctactagttattggacgcaattcactgttctctcccaaagaaacttccaagaagcgatgcccagaatgttgtccaaactgaattgggtgcaaactgtactattggggataatggcaggttttctttggttccagttggataggacggaagagtcgctgcatgatatacagggttggatgttcttctctaccacctactggatgctgttttcacattttggagctctcattcctccagaacgtgaagtgatcaataaagagagactttctggtgcatacagactgtcagcgtactatttggcaaaaatggttggcgaactacctctgattgtaactcttccaggtgtatatttccttatttcctatcccatgatgggaattcattctatcatggtgttttttattcaactgttatttctgttgctgaactccctcgttgctcagagtatcggcttcttcattggggcgtgttgtatggatatggagaccagcgtcactatcagcgccctctatacactcgcaacgcaacttttcagcggtttcctggcgacaaacataccgtggtggcttacgtggatgcgatatttgtcgatggtccattatgcttatcagaacatgcagattgttgaattcggagaaggaatggaaatcaagtgcggatcccaatccaagttcgaaatatgttcaaaaggtgccgaaaccataccagtgagtgccatactagaggctcagggatcatatcttccgctttgggcaaacactctcattctgttgtgcttcttcgtcgtcctgcgtgtcagtggttacgctgttcttcgttacttgaagacggcaaag

SEQ ID NO: 1147 - DNA, 618 bp, Leptinotarsa decemlineata
atggatgtttgttggttggttgattggttggttgatcctatgacttcccatattgctccaccggatagtgatcagagaggatattcaggagtaccatatgtcttgacggaaaccagactgcaacagatccgccaaaatttcatgtatccctactacaacagaggcggtaatgcagatgacgaaggagactaccagaaagaaattcaatcatctattccgcaagtgtacaagaacctcaacttccaactccctttcttcggatttcgattcaattacacgagggtctccttgaacggttatttggaattcagcgatcctcctccaaattacgactatcctttggtctttccagtaaaggaatggcctaaaaagaacgatccttctttcatcggtatctttttcagtaaatgtagaatcggtaacctgagggacggagatattgatcaaagagaccctggagtgtactttaggatggaaagggatctcagaaataggcaggacaggatgggagtggagatcagagaacgactgaaatgggatataagggaaggggtgatagggtcagaaacattcaatcccaaacacgccattatcgtcacatggaaaaatatctctttc

SEQ ID NO: 1148 - DNA, 786 bp, Leptinotarsa decemlineata
agaaaaggagaaggaggagttcccgcttttgtgggattcaacgctggaaacggtactagaagttttgaatacaaaccatacagtcaagaatctgttattcgagatctcacacaaactggtttcgctaatggtttcaaaggaaggcacattttccgaatcgacgaaaatatcctaactggaacatgcaataaagatatagatggtgctaatctaccgttaatgatatctccagaaagtggaaatatgctgggtggaacaatagtgaatataacaggaccttgtttcggcctagacgaccaagttaaatgcaaatttgatgtagccgatgaaataaatggcgtcgttatagataaaaacagggctatatgcatccaacctagactgtatgccgaaggatgggtgaatttacaaatagccataggggctggggtatacaaatggaagggaaaatattatgtcgaatcccccgcagcggcatctcaaaaaatctacttcaaggacatgaaggttcatgaaaaatcgcctagtgaaataagaataacttgggaaaaatacaacttgaccactaacgaaaacgctaacattcgcatctccttatggggttacagagaaacaacaataaggccaacgttcgtttacatcactgatatcgcagacagtctccaaaatactggagagtataccatcgtaccgtcccaatatagaacaaaagttaatgagtttctcacggatatcaaatttggtttcttgcaaattaacttgactgaatctatcaaagtaagttta

SEQ ID NO: 1149 - DNA, 20 bp, Artificial Sequence
  synthetic primer sequence
aggagcagatccacgagctc

SEQ ID NO: 1150 - DNA, 19 bp, Artificial Sequence
  synthetic primer sequence
actccacgaagcagaagcc

SEQ ID NO: 1151 - DNA, 22 bp, Artificial Sequence
  synthetic primer sequence
aatgtttacctatccaagcatg

SEQ ID NO: 1152 - DNA, 21 bp, Artificial Sequence
  synthetic primer sequence
tcgagtggcagagtatgaatc

SEQ ID NO: 1153 - DNA, 21 bp, Artificial Sequence
  synthetic primer sequence
tcatctcgattaccgatggac

SEQ ID NO: 1154 - DNA, 20 bp, Artificial Sequence
  synthetic primer sequence
aactccagcttcatggaacc

SEQ ID NO: 1155 - DNA, 28 bp, Artificial Sequence
  synthetic primer sequence
attatatgtttagaggttgctgctttgg

SEQ ID NO: 1156 - DNA, 26 bp, Artificial Sequence
  synthetic primer sequence
caattcgttgtagaaggtatgatgcc

SEQ ID NO: 1157 - DNA, 19 bp, Artificial Sequence
  synthetic primer sequence
aggctgtggcctaccgtca

SEQ ID NO: 1158 - DNA, 18 bp, Artificial Sequence
  synthetic primer sequence
agggagccacctcccatg

SEQ ID NO: 1159 - DNA, 20 bp, Artificial Sequence
  synthetic primer sequence
acggacggtcaggtactagc

SEQ ID NO: 1160 - DNA, 24 bp, Artificial Sequence
  synthetic primer sequence
tgcgagtcttataaacaatgtgct

SEQ ID NO: 1161 - DNA, 20 bp, Artificial Sequence
  synthetic primer sequence
tgaacaacattttcggcaag

SEQ ID NO: 1162 - DNA, 18 bp, Artificial Sequence
  synthetic primer sequence
tgggcatactcgttggtg

SEQ ID NO: 1163 - DNA, 18 bp, Artificial Sequence
  synthetic primer sequence
taccgtgtgcgcaagaac

SEQ ID NO: 1164 - DNA, 20 bp, Artificial Sequence
  synthetic primer sequence
tgtcgatcttcttgctgtcg

SEQ ID NO: 1165 - DNA, 20 bp, Artificial Sequence
  synthetic primer sequence
gtctgattcgtgtggactgg

SEQ ID NO: 1166 - DNA, 20 bp, Artificial Sequence
  synthetic primer sequence
caacagtttgccataacccc

SEQ ID NO: 1167 - DNA, 21 bp, Artificial Sequence
  synthetic primer sequence
tcatctcgattaccgacggac

SEQ ID NO: 1168 - DNA, 20 bp, Artificial Sequence
  synthetic primer sequence
aactccagcttcatggaacc

SEQ ID NO: 1169 - DNA, 21 bp, Artificial Sequence
  synthetic primer sequence
tttcccaatcaggacgagatc

SEQ ID NO: 1170 - DNA, 20 bp, Artificial Sequence
  synthetic primer sequence
tgttgatctgcgaaaagctg

SEQ ID NO: 1171 - DNA, 30 bp, Artificial Sequence
  synthetic primer sequence
gtgttctagatgccacgggacaaatatctc

SEQ ID NO: 1172 - DNA, 30 bp, Artificial Sequence
  synthetic primer sequence
gtgtaagctttgccacgggacaaatatctc

SEQ ID NO: 1173 - DNA, 30 bp, Artificial Sequence
  synthetic primer sequence
gtgtggatccgtagtagtgcacggaggcgc

SEQ ID NO: 1174 - DNA, 30 bp, Artificial Sequence
  synthetic primer sequence
gtgtgaattcgtagtagtgcacggaggcgc

SEQ ID NO: 1175 - DNA, 30 bp, Artificial Sequence
  synthetic primer sequence
gtgttctagaacgccctgatcatctacgac

SEQ ID NO: 1176 - DNA, 30 bp, Artificial Sequence
  synthetic primer sequence
gtgtaagcttacgccctgatcatctacgac

SEQ ID NO: 1177 - DNA, 31 bp, Artificial Sequence
  synthetic primer sequence
gtgtggatcctggaatgtaggcggacacatc

SEQ ID NO: 1178 - DNA, 31 bp, Artificial Sequence
  synthetic primer sequence
gtgtgaattctggaatgtaggcggacacatc

SEQ ID NO: 1179 - DNA, 27 bp, Artificial Sequence
  synthetic primer sequence
gtgttctagaacgctaagtcggaggac

SEQ ID NO: 1180 - DNA, 27 bp, Artificial Sequence
  synthetic primer sequence
gtgtaagcttacgctaagtcggaggac

SEQ ID NO: 1181 - DNA, 30 bp, Artificial Sequence
  synthetic primer sequence
gtgtggatccacagtattaacatacatgcg

SEQ ID NO: 1182 - DNA, 30 bp, Artificial Sequence
  synthetic primer sequence
gtgtgaattcacagtattaacatacatgcg

SEQ ID NO: 1183 - DNA, 31 bp, Artificial Sequence
  synthetic primer sequence
gtgttctagaggtctgatcatcaagaagccc

SEQ ID NO: 1184 - DNA, 31 bp, Artificial Sequence
  synthetic primer sequence
gtgtaagcttggtctgatcatcaagaagccc

SEQ ID NO: 1185 - DNA, 31 bp, Artificial Sequence
  synthetic primer sequence
gtgtggatccaggtgcctgtcgatcttcttg

SEQ ID NO: 1186 - DNA, 31 bp, Artificial Sequence
  synthetic primer sequence
gtgtgaattcaggtgcctgtcgatcttcttg

SEQ ID NO: 1187 - DNA, 28 bp, Artificial Sequence
  synthetic primer sequence
gtgtggatccgtgagtttctattcgcag

SEQ ID NO: 1188 - DNA, 29 bp, Artificial Sequence
  synthetic primer sequence
gtgtgaattcctgagtttcaaaattggta

SEQ ID NO: 1189 - DNA, 43 bp, Artificial Sequence
  synthetic primer sequence
gaataatacgactcactatagggagaacgctaagtcggaggac

SEQ ID NO: 1190 - DNA, 46 bp, Artificial Sequence
  synthetic primer sequence
gaataatacgactcactatagggagaacagtattaacatacatgcg

SEQ ID NO: 1191 - DNA, 43 bp, Artificial Sequence
  synthetic primer sequence
gaataatacgactcactatagggagatggagcagtacaaggcc

SEQ ID NO: 1192 - DNA, 44 bp, Artificial Sequence
  synthetic primer sequence
gaataatacgactcactatagggagaaacagggcgttacgaatc

SEQ ID NO: 1193 - DNA, 19 bp, Artificial Sequence
  synthetic T7 promoter sequence
taatacgactcactatagg

What is claimed is:

1. A method for controlling an insect pest, the method comprising contacting the insect pest with a composition comprising a yeast cell comprising a nucleic acid encoding a dsRNA molecule which specifically inhibits expression of a target gene in the insect pest, thereby controlling the insect pest, wherein the insect pest is *Drosophila suzukii* and the target gene is y-tubulin 23 C (yTub23C) gene.

2. The method of claim 1, wherein the yeast cell is killed.

3. The method of claim 1, wherein the yeast cell is living.

4. The method of claim 1, wherein the composition comprising the yeast cell is present in a lure trap.

5. The method of claim 1, wherein the yeast cell is *Saccharomyces cerevisiae*.

6. The method of claim 1, wherein the yeast cell is *Hanseniaspora uvarum*.

7. The method of claim 1 wherein the dsRNA molecule targets the 3' untranslated region of the yTub23C gene.

8. The method of claim 1, wherein the dsRNA target sequence is at least 90% identical to SEQ ID NO: 4.

9. A composition comprising a yeast cell comprising an expression cassette comprising a yeast promoter operably linked to a DNA sequence encoding a dsRNA molecule which specifically inhibits expression of a target gene in *Drosophila suzukii*, wherein the target gene is y-tubulin 23 C (yTub23C) gene.

10. The composition of claim 9, wherein the yeast cell is killed.

11. The composition of claim 9, wherein the yeast cell is living.

12. The composition of claim 9, wherein the yeast cell is *Saccharomyces cerevisiae*.

13. The composition of claim 9, wherein the yeast promoter is a bacteriophage T7 promoter or a TEF1 polymerase promoter.

14. The composition of claim 9, wherein the yeast cell is *Hanseniaspora uvarum*.

15. The composition of claim 9, wherein the dsRNA molecule targets the 3' untranslated region of the yTub23C gene.

16. The composition of claim 9, wherein the dsRNA target sequence is at least 90% identical to SEQ ID NO: 4.

17. The composition of claim 9, which is present in a lure trap.

18. An expression cassette comprising a yeast promoter operably linked to a DNA sequence encoding a double stranded RNA (dsRNA) which specifically inhibits expression of a target gene in an insect pest, wherein the target gene is a yTub23C gene.

19. The expression cassette of claim 18, wherein the yeast promoter is a bacteriophage T7 promoter or a TEF1 promoter.

20. The expression cassette of claim 18, wherein the yeast promoter is an inducible promoter.

21. The expression cassette of claim 18, wherein the dsRNA molecule targets the 3' untranslated region of the yTub23C gene.

22. The expression cassette of claim 18, wherein the dsRNA target sequence is at least 90% identical to SEQ ID NO: 4.

* * * * *